US007771728B2

(12) United States Patent
Meinke et al.

(10) Patent No.: US 7,771,728 B2
(45) Date of Patent: Aug. 10, 2010

(54) METHOD FOR IDENTIFICATION, ISOLATION AND PRODUCTION OF ANTIGENS TO A SPECIFIC PATHOGEN

(75) Inventors: Andreas Meinke, Pressbaum (AT); Eszter Nagy, Vienna (AT); Uwe Von Ahsen, Vienna (AT); Christoph Klade, Wr. Neustadt (AT); Tamas Henics, Vienna (AT); Wolfgang Zauner, Vienna (AT); Duc Bui Minh, Vienna (AT); Oresta Vytvytska, Vienna (AT); Hildegard Etz, Vienna (AT); Agnieszka Dryla, Vienna (AT); Thomas Weichhart, Böheimkirchen (AT); Martin Hafner, Vienna (AT); Brigitte Tempelmaier, Vienna (AT); Claire M. Fraser, Potomac, MD (US); Steven Gill, Frederick, MD (US)

(73) Assignee: Intercell AG, Vienna (AT)

( * ) Notice: Subject to any disclaimer, the term of this patent is extended or adjusted under 35 U.S.C. 154(b) by 576 days.

(21) Appl. No.: 11/614,716

(22) Filed: Dec. 21, 2006

(65) Prior Publication Data

US 2008/0038287 A1 Feb. 14, 2008

Related U.S. Application Data

(63) Continuation of application No. 10/470,048, filed as application No. PCT/EP02/00546 on Jan. 21, 2002.

(30) Foreign Application Priority Data

Jan. 21, 2001 (AT) ................................ A 130/2001

(51) Int. Cl.
*A61K 39/085* (2006.01)
(52) U.S. Cl. ................................ 424/190.1; 424/243.1
(58) Field of Classification Search ........................ None
See application file for complete search history.

(56) References Cited

U.S. PATENT DOCUMENTS

| 5,601,831 A | * | 2/1997 | Green et al. | ............. | 424/256.1 |
| 5,980,908 A | | 11/1999 | Hook et al. | ............. | 424/243.1 |
| 6,737,248 B2 | * | 5/2004 | Kunsch et al. | ............. | 435/69.1 |

FOREIGN PATENT DOCUMENTS

| AT | 410 798 | 12/2002 |
| EP | 0786519 | 7/1997 |
| WO | WO 99/67376 | 12/1999 |
| WO | WO 00/45839 | 8/2000 |
| WO | WO 00/56357 | 9/2000 |
| WO | WO 00/68373 | 11/2000 |
| WO | WO 01/70955 | 9/2001 |
| WO | WO 01/98499 | 12/2001 |
| WO | WO 02/077183 | 10/2002 |
| WO | WO 02/094868 | 11/2002 |
| WO | WO 02/102829 | 12/2002 |
| WO | WO 03/011899 | 2/2003 |
| WO | WO 2005/009379 | 2/2005 |

OTHER PUBLICATIONS

Bowie et al. (Science, 1990, 247:1306-1310).*
Burgess et al. (J. Cell Biol. 111:2129-2138, 1990).*
Lazar et al. (Mol. Cell. Biol., 8:1247-1252, 1988).*
Greenspan et al. (Nature Biotechnology 7: 936-937, 1999).*
Georgiou et al., "Display of heterologous proteins on the surface of microorganisms: From the screening of combinatorial libraries to live recombinant vaccines," *Nature Biotechnology*, 15:29-34, 1997.
Aldrich Catalog, Aldrich Chemical Company, Inc., 1994.
Barbet, "Vaccines and molecular biology," *Veterinary Molecular Biology*, Chapter 10, http://parasite.arf.ufl.edu/path/teach/vem1531/publish/ve0018.htm (east Update Apr. 21, 1998).
Bleul et al., "Human papillomavirus type 18 E6 and E7 antibodies in human sera: increased anti-E7 prevalence in cervical cancer patients," *J. Clin. Microbiol.*, 29:1579-1588, 1991.
Bowie et al., "Deciphering the Message in Protein Sequences: Tolerance to Amino Acid Substitutions," *Science*, 247:1306-1310, 1990.
Burnie et al., "Identification of an immunodominant ABC transporter in methicillin-resistant staphylococcus aureus infections," *Infect. Immun.*, 68(6):3200-3209, 2000.
Casolini et al., "Antibody response to fibronectin-binding adhesin FnbpA in patients with staphylococcus aureus infections," *Infection and Immunity*, 66(11):5433-5442, 1998.
Etz et al., "Identification of in vivo expressed vaccine candidate antigens from staphylococcus aureus," *PNAS*, 99(10):6573-6578, 2002.

(Continued)

*Primary Examiner*—Robert B Mondesi
*Assistant Examiner*—Brian J Gangle
(74) *Attorney, Agent, or Firm*—Fulbright & Jaworski LLP

(57) ABSTRACT

Described is a method for identification, isolation and production of hyperimmune serum-reactive antigens from a specific pathogen, a tumor, an allergen or a tissue or host prone to autoimmunity, said antigens being suited for use in a vaccine for a given type of animal or for humans, which is characterized by the following steps: —providing an antibody preparation from a plasma pool of said given type of animal or from a human plasma pool or individual sera with antibodies against said specific pathogen, tumor, allergen or tissue or host prone to auto-immunity, —providing at least one expression library of said specific pathogen, tumor, allergen or tissue or host prone to auto-immunity, —screening said at least one expression library with said antibody preparation, —identifying antigens which bind in said screening to antibodies in said antibody preparation, —screening the identified antigens with individual antibody preparations from individual sera from individuals with antibodies against said specific pathogen, tumor, allergen or tissue or host prone to auto-immunity, —identifying the hyperimmune serum-reactive antigen portion of said identified antigens and which hyperimmune serum-reactive antigens bind to a relevant portion of said individual antibody preparations from said individual sera and —optionally isolating said hyperimmune serum-reactive antigens and producing said hyperimmune serum-reactive antigens by chemical or recombinant methods.

13 Claims, 11 Drawing Sheets

OTHER PUBLICATIONS

Gliden et al., "Molecular immunologic strategies to identify antigens and B-cell responses unique to multiple sclerosis," *Arch Neurol.*, 58(1):43-48, 2001.

Greenspan and Di Cera, "Defining epitopes: It's not as easy as it seems," *Nature Biotechnology*, 7:936-937, 1999.

Kaeberlein et al., "Isolating 'Uncultivable' Microorganisms in Pure Culture in a Stimulated Natural Environment," *Science*, 296:1127-1129, 2002.

Kuroda et al., "*Staphylococcus aureus* hypothetical protein SA1522," SWALL, Accession No. Q99TD3, 2001.

Kuroda et al., "*Staphylococcus aureus* hypothetical protein SAV1129," SWALL, Accession No. Q99UX5, 2001.

Kuroda et al., "*Staphylococcus aureus* hypothetical protein SAV1731," SWALL, Accession No. Q93IP4, 2001.

Kuroda et al., "Whole genome sequencing of meticillin-resistant *Staphylococcus aureus*," *Lancet*, 357:1225-1240, 2001.

Mazmanian et al., "Sortase-catalysed anchoring of surface proteins to the cell wall of *Staphylococcus aureus*," *Mol. Microbiol.*, 40:1049-1057, 2001.

Ortega-Mora et al., "Identification of cryptosporidium parvum oocyct/sprozoite antigens recognized by infected and hyperimmune lambs," *Veterinary parasitology*, 53:159-166, 1994.

Sioud et al., "Profiling the immune responses in patient sera with peptide and cDNA display libraries(review)," *International Journal of Molecular Medicine*, 6(2):123-128, 2000.

Wang et al., "Use of a gene-targeted phage display random epitope library to map an antigenic determinant on the blue tongue virus outer capsid protein VP5." *Journal of Immunological Methods*, 178(1):1-12, 1995.

"Intercell announces initiation of further phase II clinical trial of V710 an investigational vaccine to prevent *S. aureus* infection," Intercell AG Press Release, Aug. 28, 2008.

"Intercell receives milestone payment from Merck & Co. Inc. triggered by initiation of phase II clinical trial of investigational vaccine to prevent *S. aureus* infection," Intercell AG Press Release, Dec. 16, 2007.

"Prophylactic staphylococcus aureus subunit vaccine shows promising results," Intercell AG Press Release, Dec. 19, 2006.

"Staphylococcus aureus vaccine development on track—safe and immunogenic in phase I clinical trials," Intercell AG Press Release, May 18, 2007.

* cited by examiner

| SP | EXTRACELL. DOMAIN | SPACER REGION IN CELL WALL | TMD | ++ |

LPXTG

```
Pls       M---NKNS-KKKLDFLPNKLNKYSIRRFTVGTASILVGATLIFGVAND-QAEAAENNTTQ
SdrC      M--NNKKTATNRKGMIPNRLNKFSIRKYSVGTASILVGTTLIFGLSGH-EAKAAEHTNGE
SdrD      MLNRENKTAITRKGMVSNRLNKFSIRKYTVGTASILVGTTLIFGLGNQ-EAKAAESTNK
SdrE      MINRDNKKAITKKGMISNRLNKFSIRKYTVGTASILVGTTLIFGLGNQ-EAKAAE
ClfA      M-------NMKKKEKHAIRKKSIGVASVLVGTLIGFGLLSSKEADASENSVTQ
ClfB      M-------KKRIDYLSNKQNKYSIRRFTVGTTSVIVGATILFGIG-NHQAQASEQSNDT
FnBPA     M-------KNNLRYGIRKHKLGAASVFLGTMIVVGMGQDKEAAASEQKTTT
FnBPB     M-------KSNLRYGIRKHKLGAASVFLGTMIVVGMGQEKEAAASEQNNTT
Prot A    M-------KKKNIYSIRKLGVGIASVTLGTLLISGGVTPA-ANAAQHDEAQ
Mrp       M-------NLFRQQKFSIRKFNVGIFSALIATVFISTNPTT-ASAAEQNQPA
LPXTG5    M-------NKHHPKLRSFYSIRKSTLGVASVIVSTLFLITS--QHQAQAAENTNTS
LPXTG4    M-RDKKGPVNKRVDFLSNKLNKYSIRKFTVGTASILIGSLMYLGTQ--QEAEAAENNIEN
LPXTG3    M-------NLLKKNKYSIRKYKVGIFSTLIGTVLLLSNPNG--AQALTTDNNV
Lipase    M-------MKSQNKYSIRKFSVGASSILIATLLFLSGG---QAQAAEKQVNM
2992aa    M-------TIAVNYRDKIQKFSIRKYTVGTFSTVIATLVFLGFNTS-QAHAAETNQPA
Cna       M-------NKNVLKFMVFIMLLNIITPLFNKNEAFAARDISST
Map-w     M-------KFKSLITTLALGVIASTGANFNTNEASAAAKPL
LPXTG1    M-------IIYWCMTVNGGNEMKALLLKTSVWLVLLFSVMGLW-QVSNAAEQHTPM
LPXTG2    M-------SKRQKAFHDSLANEKTRVRLYKSGKNWVKSGIKEIEMFKIMGLPFISHSLVSQ
PBP2a     M-------KKIKIVPLILIVVVGFGIYFYASKDKEINNTIDAIEDKNFK
```

Figure 8A

Constitutive Cell Wall Proteins of S. aureus with LPXTG motif

| | Known proteins | Mw/pI | LPXTG | hydrophobic membrane domain | basic C-term. |
|---|---|---|---|---|---|
| 1 | Mrp protein | 255/4.6 | AKTLPDTGMSHNDDLPYAELALGAGMAFLIRRF | | TKKDQQTEE |
| 2 | Pls (MRSA) | 167/4.1 | NKELPDTGNDAQNNGTLFGSLFAALGGLFLVG | | RRRKNKNNEEK |
| 3 | SdrD (SD-repeat) | 133/4.1 | AKALPETGNENSGSNNATLFGGLFAALGSLLLF | | GRRKKQNK |
| 4 | Cna | 126/5.6 | LKELPKTGMKIITSWITWVFIGILGLYLILR | | KRFNS |
| 5 | SdrE | 117/4.1 | AKALPETGSENNGSNNATLFGGLFAALGSLLLF | | GRRKKQNK |
| 6 | FnBPA | 104/4.5 | KSELPETGGEESTNKGMLFGGLFSIIGLALLRR | | NKKNHKA |
| 7 | SdrC | 94/4.1 | AKALPETGSENNNSNNGTLFGGLFAALGSLLSF | | GRRKKQNK |
| 8 | FnBPB | 96/4.5 | KSELPETGGEESTNNGMLFGGLFSIIGLALLRR | | NKKNHKA |
| 9 | ClfA | 89/3.4 | KEPLPDTGSEDEANTSLIWGLLASIGSLLLFRR | | KKENKDKK |
| 10 | ClfB | 88/3.7 | TDALPETGDKSENTNATLFGAMMALLGSLLLF | | RKRKQDHKEKA |
| 11 | Spa (Protein A) | 48/5.2 | AQALPETGEENPFIGTTVFGGLSLALGAALLA | | GRRREL |

| | Predicted based on sequence (TIGR) | | | | |
|---|---|---|---|---|---|
| 1 | LPXTGp1 | 79/9.3 | EKQLPKTGTNKSSSPEAMFVLLAGIGLIATV | | RRRKAS |
| 2 | LPXTGp2 | 227/4.2 | EKRLPDTGDSIKQNGLLGGVMTLLVGLMKR | | KKKKDEND |
| 3 | LPXTGp3 | 200/4.1 | EKELPNTGSEGMDLPLKEFALITGAALLARR | | RTKNEKES |
| 4 | LPXTGp4 | 122/5.8 | RAELPKTGLESTQKGLIFSSTIGIAGLMLLA | | RRRKN |
| 5 | LPXTGp5 | 101/5.0 | SKMLPKTGETTSSQSWWGLYALLGMLALFIPK | | FRKESK |

Figure 8B

METHOD FOR IDENTIFICATION, ISOLATION AND PRODUCTION OF ANTIGENS TO A SPECIFIC PATHOGEN

This application is a continuation of U.S. application Ser. No. 10/470,048 filed Feb. 6, 2004, which is a U.S. National Phase Application under 35 U.S.C. §371 of PCT Application No. PCT/EP2002/00546 filed Jan. 21, 2002 which claims priority to Austrian Application No. A 130/2001 filed Jan. 21, 2001, the entire contents of each of which are incorporated herein by reference.

The invention relates to a method for identification, isolation and production of antigens to a specific pathogen as well as new antigens suitable for use in a vaccine for a given type of animal or for humans.

Vaccines can save more lives (and resources) than any other medical intervention. Owing to world-wide vaccination programmes the incidence of many fatal diseases has been decreased drastically. Although this notion is valid for a whole panel of diseases, e.g. diphtheria, pertussis, measles and tetanus, there are no effective vaccines for numerous infectious disease including most viral infections, such as HIV, HCV, CMV and many others. There are also no effective vaccines for other diseases, infectious or noninfectious, claiming the lifes of millions of patients per year including malaria or cancer. In addition, the rapid emergence of antibiotic-resistant bacteria and microorganisms calls for alternative treatments with vaccines being a logical choice. Finally, the great need for vaccines is also illustrated by the fact that infectious diseases, rather than cardiovascular disorders or cancer or injuries remain the largest cause of death and disability in the world.

Several established vaccines consist of live attenuated organisms where the risk of reversion to the virulent wild-type strain exists. In particular in immunocompromised hosts this can be a live threatening scenario. Alternatively, vaccines are administered as a combination of pathogen-derived antigens together with compounds that induce or enhance immune responses against these antigens (these compounds are commonly termed adjuvant), since these subunit vaccines on their own are generally not effective.

Whilst there is no doubt that the above vaccines are valuable medical treatments, there is the disadvantage that, due to their complexity, severe side effects can be evoked, e.g. to antigens that are contained in the vaccine that display cross-reactivity with molecules expressed by cells of vaccinated individuals. In addition, existing requirements from regulatory authorities, e.g. the World Health Organization (WHO), the Food and Drug Administration (FDA), and their European counterparts, for exact specification of vaccine composition and mechanisms of induction of immunity, are difficult to meet.

Some widely used vaccines are whole cell-vaccines (attenuated bacteria or viruses (e.g. Bacille Calmette-Guerin (BCG) (tuberculosis), Measles, Mumps, Rubella, Oral Polio Vaccine (Sabin), killed bacteria or viruses (e.g. Pertussis, Inactivated polio vaccine (Salk)), subunit-vaccines (e.g. Toxoid (Diphtheria, Tetanus)), Capsular polysaccharide (*H. influenzae* type B), Yeast recombinant subunit (Hepatitis B surface protein).

A vaccine can contain a whole variety of different antigens. Examples of antigens are whole-killed organisms such as inactivated viruses or bacteria, fungi, protozoa or even cancer cells. Antigens may also consist of subfractions of these organisms/tissues, of proteins, or, in their most simple form, of peptides. Antigens can also be recognized by the immune system in form of glycosylated proteins or peptides and may also be or contain polysaccharides or lipids. Short peptides can be used since for example cytotoxic T-cells (CTL) recognize antigens in form of short usually 8-11 amino acids long peptides in conjunction with major histocompatibility complex (MHC). B-cells can recognize linear epitopes as short as 4-5 amino acids, as well as three dimensional structures (conformational epitopes). In order to obtain sustained, antigen-specific immune responses, adjuvants need to trigger immune cascades that involve all cells of the immune system necessary. Primarily, adjuvants are acting, but are not restricted in their mode of action, on so-called antigen presenting cells (APCs). These cells usually first encounter the antigen(s) followed by presentation of processed or unmodified antigen to immune effector cells. Intermediate cell types may also be involved. Only effector cells with the appropriate specificity are activated in a productive immune response. The adjuvant may also locally retain antigens and co-injected other factors. In addition the adjuvant may act as a chemoattractant for other immune cells or may act locally and/or systemically as a stimulating agent for the immune system.

Antigen presenting cells belong to the innate immune system, which has evolved as a first line host defense that limits infection early after exposure to microorganisms. Cells of the innate immune system recognize patterns or relatively non-specific structures expressed on their targets rather than more sophisticated, specific structures which are recognized by the adaptive immune system. Examples of cells of the innate immune system are macrophages and dendritic cells but also granulocytes (e.g. neutrophils), natural killer cells and others. By contrast, cells of the adaptive immune system recognize specific, antigenic structures, including peptides, in the case of T-cells and peptides as well as three-dimensional structures in the case of B-cells. The adaptive immune system is much more specific and sophisticated than the innate immune system and improves upon repeated exposure to a given pathogen/antigen. Phylogenetically, the innate immune system is much older and can be found already in very primitive organisms. Nevertheless, the innate immune system is critical during the initial phase of antigenic exposure since, in addition to containing pathogens, cells of the innate immune system, i.e. APCs, prime cells of the adaptive immune system and thus trigger specific immune responses leading to clearance of the intruders. In sum, cells of the innate immune system and in particular APCs play a critical role during the induction phase of immune responses by a) containing infections by means of a primitive pattern recognition system and b) priming cells of the adaptive immune system leading to specific immune responses and memory resulting in clearance of intruding pathogens or of other targets. These mechanisms may also be important to clear or contain tumor cells.

The antigens used for such vaccines have often been selected by chance or by easiness of availability. There is a demand to identify efficient antigens for a given pathogen or—preferably—an almost complete set of all antigens of a given pathogen which are practically (clinically) relevant. Such antigens may be preferred antigen candidates in a vaccine.

It is therefore an object of the present invention to comply with these demands and to provide a method with which such antigens may be provided and with which a practically complete set of antigens of e.g. a given pathogen may be identified with a given serum as antibody source. Such a method should also be suitable for rapidly changing pathogens which evolve a fast resistance against common drugs or vaccines. The method should also be applicable to identify and isolate tumor antigens, allergens, auto-immune antigens.

Therefore, the present invention provides a method for identification, isolation and production of hyperimmune serum-reactive antigens from a specific pathogen, a tumor, an allergen or a tissue or host prone to auto-immunity, especially from a specific pathogen, said antigens being suited for use in a vaccine for a given type of animal or for humans, said method being characterized by the following steps:

providing an antibody preparation from a plasma pool of said given type of animal or from a human plasma pool or individual sera with antibodies against said specific pathogen, a tumor, an allergen or a tissue or host prone to auto-immunity, providing at least one expression library of said specific pathogen, a tumor, an allergen or a tissue or host prone to auto-immunity, screening said at least one expression library with said antibody preparation, identifying antigens which bind in said screening to antibodies in said antibody preparation, screening the identified antigens with individual antibody preparations from individual sera from individuals with antibodies against said specific pathogen, tumor, allergen or tissue or host prone to auto-immunity, identifying the hyperimmune serum-reactive antigen portion of said identified antigens which hyperimmune serum-reactive antigens bind to a relevant portion of said individual antibody preparations from said individual sera and optionally isolating said hyperimmune serum-reactive antigens and producing said hyperimmune serum-reactive antigens by chemical or recombinant methods.

This method is also suitable in general for identifying a practically complete set of hyperimmune serum-reactive antigens of a specific pathogen with given sera as antibody sources, if at least three different expression libraries are screened in a pathogen/antigen identification programme using the method according to the present invention. The present invention therefore also relates to a method for identification, isolation and production of a practically complete set of hyperimmune serum-reactive antigens of a specific pathogen, said antigens being suited for use in a vaccine for a given type of animal or for humans, which is characterized by the following steps:

providing an antibody preparation from a plasma pool of said given type of animal or from a human plasma pool or individual sera with antibodies against said specific pathogen, providing at least three different expression libraries of said specific pathogen, screening said at least three different expression libraries with said antibody preparation, identifying antigens which bind in at least one of said at least three screenings to antibodies in said antibody preparation, screening the identified antigens with individual antibody preparations from individual sera from individuals with antibodies against said specific pathogen, identifying the hyperimmune serum-reactive antigen portion of said identified antigens which hyperimmune serum-reactive antigens bind to a relevant portion of said individual antibody preparations from said individual sera, repeating said screening and identification steps at least once, comparing the identified hyperimmune serum-reactive antigens identified in the repeated screening and identification steps with the identified hyperimmune serum-reactive antigens identified in the initial screening and identification steps, further repeating said screening and identification steps, if at least 5% of the hyperimmune serum-reactive antigens have been identified in the repeated screening and identification steps only, until less than 5% of the hyperimmune serum-reactive antigens are identified in a further repeating step only to obtain a complete set of hyperimmune serum-reactive antigens of a specific pathogen and optionally isolating said hyperimmune serum-reactive antigens and producing said hyperimmune serum-reactive antigens by chemical or recombinant methods.

The method according to the present invention mainly consists of three essential parts, namely 1. identifying hyperimmune serum sources containing specific antibodies against a given pathogen, 2. screening of suitable expression libraries with a suitable antibody preparation wherein candidate antigens (or antigenic fragments of such antigens) are selected, and—3. in a second screening round, wherein the hyperimmune serum-reactive antigens are identified by their ability to bind to a relevant portion of individual antibody preparations from individual sera in order to show that these antigens are practically relevant and not only hyperimmune serum-reactive, but also widely immunogenic (i.e. that a lot of individual sera react with a given antigen). With the present method it is possible to provide a set of antigens of a given pathogen which is practically complete with respect to the chosen pathogen and the chosen serum. Therefore, a bias with respect to "wrong" antigen candidates or an incomplete set of antigens of a given pathogen is excluded by the present method.

Completeness of the antigen set of a given pathogen within the meaning of the present invention is, of course, dependent on the completeness of the expression libraries used in the present method and on the quality and size of serum collections (number of individual plasmas/sera tested, both with respect to representability of the library and usefulness of the expression system. Therefore, preferred embodiments of the present method are characterized in that at least one of said expression libraries is selected from a ribosomal display library, a bacterial surface library and a proteome.

A serum collection used in the present invention should be tested against a panel of known antigenic compounds of a given pathogen, such as polysaccharide, lipid and proteinaceous components of the cell wall, cell membranes and cytoplasma, as well as secreted products. Preferably, three distinct serum collections are used: 1. With very stable antibody repertoire: normal adults, clinically healthy people, who overcome previous encounters or currently carriers of e.g. a given pathogen without acute disease and symptoms, 2. With antibodies induced actually by the presence of the pathogenic organism: patients with acute disease with different manifestations (e.g. S. aureus sepsis or wound infection, etc.), 3. With no specific antibodies at all (as negative controls): 5-8 months old babies who lost the maternally transmitted immunoglobulins 5-6 months after birth. Sera have to react with multiple pathogen-specific antigens in order to consider hyperimmune for a given pathogen (bacteria, fungus, worm or otherwise), and for that relevant in the screening method according to the present invention.

In the antigen identification programme for identifying a complete set of antigens according to the present invention, it is preferred that said at least three different expression libraries are at least a ribosomal display library, a bacterial surface library and a proteome. It has been observed that although all expression libraries may be complete, using only one or two expression libraries in an antigen identification programme will not lead to a complete set of antigens due to preferential expression properties of each of the different expression libraries. While it is therefore possible to obtain hyperimmune serum-reactive antigens by using only one or two different expression libraries, this might in many cases not finally result in the identification of a complete set of hyperimmune serum-reactive antigens. Of course, the term "complete" according to the present invention does not indicate a theoretical maximum but is indeed a practical completeness, i.e. that at least 95% of the practically relevant antigens or antigenic determinants have been identified of a given pathogen. The practical relevance is thereby defined by the occurrence of antibodies against given antigens in the patient population.

According to the present invention also serum pools or plasma fractions or other pooled antibody containing body fluids are "plasma pools".

An expression library as used in the present invention should at least allow expression of all potential antigens, e.g. all surface proteins of a given pathogen. With the expression libraries according to the present invention, at least one set of potential antigens of a given pathogen is provided, this set being preferably the complete theoretical complement of (poly-)peptides encoded by the pathogen's genome (i.e. genomic libraries as described in Example 2) and expressed either in a recombinant host (see Example 3) or in vitro (see Example 4). This set of potential antigens can also be a protein preparation, in the case of extracellular pathogens preferably a protein preparation containing surface proteins of said pathogen obtained from said pathogen grown under defined physiological conditions (see Example 5). While the genomic approach has the potential to contain the complete set of antigens, the latter one has the advantage to contain the proteins in their naturally state i.e. including for instance post-translational modifications or processed forms of these proteins, not obvious from the DNA sequence. These or any other sets of potential antigens from a pathogen, a tumor, an allergen or a tissue or host prone to auto-immunity are hereafter referred to as "expression library". Expression libraries of very different kinds may be applied in the course of the present invention. Suitable examples are given in e.g. Ausubel et al., 1994. Especially preferred are expression libraries representing a display of the genetic set of a pathogen in recombinant form such as in vitro translation techniques, e.g. ribosomal display, or prokaryotic expression systems, e.g. bacterial surface expression libraries or which resemble specific physiological expression states of a given pathogen in a given physiological state, such as a proteome.

Ribosome display is an established method in recombinant DNA technology, which is applicable for each specific pathogen for the sake of the present invention (Schaffitzel et al, 1999). Bacterial surface display libraries will be represented by a recombinant library of a bacterial host displaying a (total) set of expressed peptide sequences of a given pathogen on e.g. a selected outer membrane protein at the bacterial host membrane (Georgiou et al., 1997). Apart from displaying peptide or protein sequences in an outer membrane protein, other bacterial display techniques, such as bacteriophage display technologies and expression via exported proteins are also preferred as bacterial surface expression library (Forrer et al., 1999; Rodi and Makowski, 1993; Georgiou et al., 1997).

The antigen preparation for the first round of screening in the method according to the present invention may be derived from any source containing antibodies to a given pathogen. Preferably, if a plasma pool is used as a source for the antibody preparation, a human plasma pool is selected which comprises donors which had experienced or are experiencing an infection with the given pathogen. Although such a selection of plasma or plasma pools is in principle standard technology in for example the production of hyperimmunoglobulin preparations, it was surprising that such technologies have these effects as especially shown for the preferred embodiments of the present invention.

Preferably the expression libraries are genomic expression libraries of a given pathogen, or alternatively m-RNA, libraries. It is preferred that these genomic or m-RNA libraries are complete genomic or m-RNA expression libraries which means that they contain at least once all possible proteins, peptides or peptide fragments of the given pathogen are expressable. Preferably the genomic expression libraries exhibit a redundancy of at least 2×, more preferred at least 5×, especially at least 10×.

Preferably, the method according to the present invention comprises screening at least a ribosomal display library, a bacterial surface display library and a proteome with the antibody preparation and identifying antigens which bind in at least two, preferably which bind to all, of said screenings to antibodies in said antibody preparation. Such antigens may then be regarded extremely suited as hyperimmunogenic antigens regardless of their way of expression. Preferably the at least two screenings should at least contain the proteome, since the proteome always represents the antigens as naturally expressed proteins including post-translational modifications, processing, etc. which are not obvious from the DNA sequence.

The method according to the present invention may be applied to any given pathogen. Therefore, preferred pathogens are selected from the group of bacterial, viral, fungal and protozoan pathogens. The method according to the present invention is also applicable to cancer, i.e. for the identification of tumor-associated antigens, and for the identification of allergens or antigens involved in auto-immune diseases. Of course, especially the recombinant methods are rather simple for pathogens having a small genome or a comparatively small number of expressed proteins (such as bacterial or viral pathogens) and are more complicated for complex (eukaryotic) organisms having large genomes. However, also such large genomic libraries of higher organism pathogens may well be analyzed with the method according to the present invention, at least in a faster and more reliable way than with known methods for identifying suitable antigens.

Preferred pathogens to be analyzed or which antigens are to be extracted, respectively, include human immunodeficiency virus (HIV), hepatitis A virus (HAV), hepatitis B virus (HBV), hepatitis C virus (HCV), Rous sarcoma virus (RSV), Epstein-Barr virus (EBV), influenza virus (IV), rotavirus (RV), *Staphylococcus aureus* (*S. aureus*), *Staphylococcus epidermidis* (*S. epidermidis*), *Chlamydia pneumoniae* (*C. pneumoniae*), *Chlamydia trachomatis* (*C. trachomatis*), *Mycobacterium tuberculosis* (*M. tuberculosis*), *Mycobacterium leprae* (*M. leprae*), *Streptococcus pneumoniae* (*S. pneumoniae*), *Streptococcus pyogenes* (*S. pyogenes*), *Streptococcus agalactiae* (*S. agalactiae*), *Enterococcus faecalis* (*E. faecalis*), *Bacillus anthracis* (*B. anthracis*), *Vibrio cholerae* (*V. cholerae*), *Borrelia burgdorferi* (*B. burgdorferi*), *Plasmodium* sp., fungal diseases such as *Pneumocystis carinii*, *Aspergillus* sp., *Cryptococcus* sp., *Candida albicans* or parasitic infections such as ascariasis (*Ascaris lumbricoides*) and taeniasis (*Taenia saginata*). The method according to the present invention is most applicable for bacteria, worms or candida.

As a model organism for the present application *Staphylococcus aureus* has been chosen to demonstrate the applicability and efficacy of the method according to the present invention. Especially with respect to the examples it is clear that the invention is easily transferable to all potential pathogens, especially the ones listed above.

It was surprising that the method according to the present invention allows an efficient and fast biological screening of a given pathogen, especially in view of the fact that only a small fraction of a patient's antibody repertoire is directed to a given pathogen, even in a state where this pathogen is effectively defeated. It has been discovered within the course of the present invention, especially during performance of the S. aureus example that only 1-2% of the antibody repertoire of a patient having high titers against S. aureus are indeed antibodies directed against S. aureus. Moreover, over 70% of this specific 1% portion is directed against non-protein antigens, such as teichoic acid, so that only a total of 0.1% or less of the antibodies are directed to proteinaceous antigens.

One of the advantages of using recombinant expression libraries, especially ribosome display libraries and bacterial surface display libraries, is that the identified hyperimmune serum-reactive antigens may be instantly produced by expression of the coding sequences of the screened and selected clones expressing the hyperimmune serum-reactive antigens without further recombinant DNA technology or cloning steps necessary.

The hyperimmune serum-reactive antigens obtainable by the method according to the present invention may therefore be immediately finished to a pharmaceutical preparation, preferably by addition of a pharmaceutically acceptable carrier and/or excipient, immediately after its production (in the course of the second selection step), e.g. by expression from the expression library platform.

Preferably, the pharmaceutical preparation containing the hyperimmune serum-reactive antigen is a vaccine for preventing or treating an infection with the specific pathogen for which the antigens have been selected.

The pharmaceutical preparation may contain any suitable auxiliary substances, such as buffer substances, stabilisers or further active ingredients, especially ingredients known in connection of vaccine production.

A preferable carrier/or excipient for the hyperimmune serum-reactive antigens according to the present invention is a immunostimulatory compound for further stimulating the immune response to the given hyperimmune serum-reactive antigen. Preferably the immunostimulatory compound in the pharmaceutical preparation according to the present invention is selected from the group of polycationic substances, especially polycationic peptides, immunostimulatory deoxynucleotides, alumn, Freund's complete adjuvans, Freund's incomplete adjuvans, neuroactive compounds, especially human growth hormone, or combinations thereof.

The polycationic compound(s) to be used according to the present invention may be any polycationic compound which shows the characteristic effects according to the WO 97/30721. Preferred polycationic compounds are selected from basic polypeptides, organic polycations, basic polyamino acids or mixtures thereof. These polyamino acids should have a chain length of at least 4 amino acid residues (see: Tuftsin as described in Goldman et al. (1983)). Especially preferred are substances like polylysine, polyarginine and polypeptides containing more than 20%, especially more than 50% of basic amino acids in a range of more than 8, especially more than 20, amino acid residues or mixtures thereof. Other preferred polycations and their pharmaceutical compositions are described in WO 97/30721 (e.g. polyethyleneimine) and WO 99/38528. Preferably these polypeptides contain between 20 and 500 amino acid residues, especially between 30 and 200 residues.

These polycationic compounds may be produced chemically or recombinantly or may be derived from natural sources.

Cationic (poly)peptides may also be anti-microbial with properties as reviewed in Ganz et al, 1999; Hancock, 1999. These (poly)peptides may be of prokaryotic or animal or plant origin or may be produced chemically or recombinantly (Andreu et al., 1998; Ganz et al., 1999; Simmaco et al., 1998). Peptides may also belong to the class of defensins (Ganz, 1999; Ganz et al., 1999). Sequences of such peptides can be, for example, be found in the Antimicrobial sequences Database on the world wide web at: bbcm.univ.trieste.it/.about. tossi/pag2.html Such host defense peptides or defensives are also a preferred form of the polycationic polymer according to the present invention. Generally, a compound allowing as an end product activation (or down-regulation) of the adaptive immune system, preferably mediated by APCs (including dendritic cells) is used as polycationic polymer.

Especially preferred for use as polycationic substance in the present invention are cathelicidin derived antimicrobial peptides or derivatives thereof (International patent application PCT/EP01/09529, incorporated herein by reference), especially antimicrobial peptides derived from mammal cathelicidin, preferably from human, bovine or mouse.

Polycationic compounds derived from natural sources include HIV-REV or HIV-TAT (derived cationic peptides, antennapedia peptides, chitosan or other derivatives of chitin) or other peptides derived from these peptides or proteins by biochemical or recombinant production. Other preferred polycationic compounds are cathelin or related or derived substances from cathelin. For example, mouse cathelin is a peptide which has the amino acid sequence $NH_2$—RLAGLL-RKGGEKIGEKLKKIGQKIKNFFQKLVPQPE-COOH (SEQ ID NO:599). Related or derived cathelin substances contain the whole or parts of the cathelin sequence with at least 15-20 amino acid residues. Derivations may include the substitution or modification of the natural amino acids by amino acids which are not among the 20 standard amino acids. Moreover, further cationic residues may be introduced into such cathelin molecules. These catheline molecules are preferred to be combined with the antigen. These cathelin molecules surprisingly have turned out to be also effective as an adjuvant for an antigen without the addition of further adjuvants. It is therefore possible to use such cathelin molecules as efficient adjuvants in vaccine formulations with or without further immunactivating substances.

Another preferred polycationic substance to be used according to the present invention is a synthetic peptide containing at least 2 KLK-motifs separated by a linker of 3 to 7 hydrophobic amino acids (International patent application PCT/EP01/12041, incorporated herein by reference).

Immunostimulatory deoxynucleotides are e.g. neutral or artificial CpG containing DNA, short stretches of DNA derived from non-vertebrates or in form of short oligonucleotides (ODNs) containing non-methylated cytosine-guanine di-nucleotides (CpG) in a certain base context (e.g. Krieg et al., 1995) but also inosine containing ODNs (I-ODNs) as described in WO 01/93905.

Neuroactive compounds, e.g. combined with polycationic substances are described in WO 01/24822.

According to a preferred embodiment the individual antibody preparation for the second round of screening are derived from patients with have suffered from an acute infection with the given pathogen, especially from patients who show an antibody titer to the given pathogen above a certain minimum level, for example an antibody titer being higher than 80 percentile, preferably higher than 90 percentile, especially higher than 95 percentile of the human (patient or carrier) sera tested. Using such high titer individual antibody preparations in the second screening round allows a very selective identification of the hyperimmune serum-reactive antigens to the given pathogen.

It is important that the second screening with the individual antibody preparations (which may also be the selected serum) allows a selective identification of the hyperimmune serum-reactive antigens from all the promising candidates from the first round. Therefore, preferably at least 10 individual antibody preparations (i.e. antibody preparations (e.g. sera) from at least 10 different individuals having suffered from an infection to the chosen pathogen) should be used in identifying these antigens in the second screening round. Of course, it is possible to use also less than 10 individual preparations, however, selectivity of the step may not be optimal with a low number of individual antibody preparations. On the other hand, if a given hyperimmune serum-reactive antigen (or an antigenic fragment thereof) is recognized in at least 10 individual antibody preparations, preferably at least 30, especially at least 50 individual antibody preparations, identification of hyperimmune serum-reactive antigen is also selective enough for a proper identification. Hyperimmune serum-reactivity may of course be tested with as many individual preparations as possible (e.g. with more than 100 or even with more than 1000).

Therefore, the relevant portion of the hyperimmune serum-reactive antibody preparation according to the method of the present invention should preferably be at least 10, more preferred at least 30, especially at least 50 individual antibody preparations. Alternatively (or in combination) hyperimmune serum-reactive antigen may preferably be also identified with at least 20%, preferably at least 30%, especially at least 40% of all individual antibody preparations used in the second screening round.

According to a preferred embodiment of the present invention, the sera from which the individual antibody preparations for the second round of screening are prepared (or which are used as antibody preparations), are selected by their titer against the specific pathogen (e.g. against a preparation of this pathogen, such as a lysate, cell wall components and recombinant proteins). Preferably, some are selected with a total IgA titer above 4000 U, especially above 6000 U, and/or an IgG titer above 10 000 U, especially above 12 000 U (U=units, calculated from the $OD_{405nm}$ reading at a given dilution) when whole organism (total lysate or whole cells) is used as antigen in ELISA. Individual proteins with Ig titers of above 800-1000 U are specifically preferred for selecting the hyperimmune serum-reactive antigens according to the present invention only for total titer. The statement for individual proteins can be derived from FIG. 9.

According to the demonstration example which is also a preferred embodiment of the present invention the given pathogen is a *Staphylococcus* pathogen, especially *Staphylococcus aureus* and *Staphylococcus epidermidis*. Staphylococci are opportunistic pathogens which can cause illnesses which range from minor infections to life threatening diseases. Of the large number of Staphylococci at least 3 are commonly associated with human disease: *S. aureus, S. epidermidis* and rarely *S. saprophyticus* (Crossley and Archer, 1997). *S. aureus* has been used within the course of the present invention as an illustrative example of the way the present invention functions. Besides that, it is also an important organism with respect to its severe pathogenic impacts on humans. Staphylococcal infections are imposing an increasing threat in hospitals worldwide. The appearance and disease causing capacity of Staphylococci are related to the widespread use of antibiotics which induced and continue to induce multi-drug resistance. For that reason medical treatment against Staphylococcal infections cannot rely only on antibiotics anymore. Therefore, a tactic change in the treatment of these diseases is desperately needed which aims to prevent infections. Inducing high affinity antibodies of the opsonic and neutralizing type by vaccination helps the innate immune system to eliminate bacteria and toxins. This makes the method according to the present invention an optimal tool for the identification of staphylococcal antigenic proteins.

Every human being is colonized with *S. epidermidis*. The normal habitats of *S. epidermidis* are the skin and the mucous membrane. The major habitats of the most pathogenic species, *S. aureus*, are the anterior nares and perineum. Some individuals become permanent *S. aureus* carriers, often with the same strain. The carrier stage is clinically relevant because carriers undergoing surgery have more infections than noncarriers. Generally, the established flora of the nose prevents acquisition of new strains. However, colonization with other strains may occur when antibiotic treatment is given that leads to elimination of the susceptible carrier strain. Because this situation occurs in the hospitals, patients may become colonized with resistant nosocomial Staphylococci. These bacteria have an innate adaptability which is complemented by the widespread and sometimes inappropriate use of antimicrobial agents. Therefore hospitals provide a fertile environment for drug resistance to develop (close contact among sick patients, extensive use of antimicrobials, nosocomial infections). Both *S. aureus* and *S. epidermidis* have become resistant to many commonly used antibiotics, most importantly to methicillin (MRSA) and vancomycin (VISA). Drug resistance is an increasingly important public health concern, and soon many infections caused by staphylococci may be untreatable by antibiotics. In addition to its adverse effect on public health, antimicrobial resistance contributes to higher health care costs, since treating resistant infections often requires the use of more toxic and more expensive drugs, and can result in longer hospital stays for infected patients.

Moreover, even with the help of effective antibiotics, the most serious staphylococcal infections have 30-50% mortality.

Staphylococci become potentially pathogenic as soon as the natural balance between microorganisms and the immune system gets disturbed, when natural barriers (skin, mucous membrane) are breached. The coagulase-positive *S. aureus* is the most pathogenic staphylococcal species, feared by surgeons for a long time. Most frequently it causes surgical wound infections, and induces the formation of abscesses. This local infection might become systemic, causing bacteraemia and sepsis. Especially after viral infections and in elderly, it can cause severe pneumonia. *S. aureus* is also a frequent cause of infections related to medical devices, such as intravascular and percutan catheters (endocarditis, sepsis, peritonitis), prosthetic devices (septic arthritis, osteomyelitis). *S. epidermidis* causes diseases mostly related to the presence of foreign body and the use of devices, such as catheter related infections, cerebrospinal fluid shunt infections, peritonitis in dialysed patients (mainly CAPD), endocarditis in individuals with prosthetic valves. This is exemplified in immunocompromised individuals such as oncology patients and pre-mature neonates in whom coagulase-negative staphylococcal infections frequently occur in association with the use of intravascular device. The increase in incidence is related to the increased used of these devices and increasing number of immunocompromised patients.

Much less is known about *S. saprophyticus*, another coagulase-negative staphylococci, which causes acute urinary tract infection in previously healthy people. With a few exceptions these are women aged 16-25 years.

The pathogenesis of staphylococci is multifactorial. In order to initiate infection the pathogen has to gain access to the cells and tissues of the host, that is adhere. *S. aureus* expresses-surface proteins that promote attachment to the host proteins such as laminin, fibronectin, elastin, vitronectin, fibrinogen and many other molecules that form part of the extracellular matrix (extracellular matrix binding proteins, ECMBP). *S. epidermidis* is equipped with cell surface molecules which promote adherence to foreign material and through that mechanism establish infection in the host. The other powerful weapons staphylococci use are the secreted products, such as enterotoxins, exotoxins, and tissue damaging enzymes. The toxins kill or misguide immune cells which are important in the host defense. The several different types of toxins are responsible for most of the symptoms during infections.

Host defense against *S. aureus* relies mainly on innate immunological mechanisms. The skin and mucous membranes are formidable barriers against invasion by Staphylococci. However, once the skin or the mucous membranes are breached (wounds, percutan, catheters, etc), the first line of nonadaptive cellular defense begins its co-ordinate action through complement and phagocytes, especially the polymorphonuclear leukocytes (PMNs). These cells can be regarded as the cornerstones in eliminating invading bacteria. As Staphylococci are primarily extracellular pathogens; the major anti-staphylococcal adaptive response comes from the humoral arm of the immune system, and is mediated through three major mechanisms: promotion of opsonization, toxin neutralisation, and inhibition of adherence. It is believed that opsonization is especially important, because of its requirement for an effective phagocytosis. For efficient opsonization the microbial surface has to be coated with antibodies and complement factors for recognition by PMNs through receptors to the Fc fragment of the IgG molecule or to activated C3b. After opsonization, staphylococci are phagocytosed and killed. Moreover, *S. aureus* can attach to endothelial cells, and be internalised by a phagocytosis-like process. Antibodies bound to specific antigens on the cell surface of bacteria serve as ligands for the attachment to PMNs and promote phagocytosis. The very same antibodies bound to the adhesins and other cell surface proteins are expected to neutralize adhesion and prevent colonization.

There is little clinical evidence that cell mediated immunity has a significant contribution in the defense against Staphylococci, yet one has to admit that the question is not adequately addressed. It is known, however, that *Staphylococcus aureus* utilizes an extensive array of molecular countermeasures to manipulate the defensive microenvironment of the infected host by secreting polypeptides referred to as superantigens, which target the multireceptor communication between T-cells and antigen-presenting cells that is fundamental to initiating pathogen-specific immune clearance. Superantigens play a critical role in toxic shock syndrome and food poisoning, yet their function in routine infections is not well understood. Moreover, one cannot expect a long lasting antibody (memory) response without the involvement of T-cells. It is also known that the majority of the anti-staphylococcal antibodies are against T-cell independent antigens (capsular polysaccharides, lipoteichoic acid, peptidoglycan) without a memory function. The T-cell dependent proteinaceous antigens can elicit long-term protective antibody responses. These staphylococcal proteins and peptides have not yet been determined.

For all these above mentioned reasons, a tactic change on the war field against staphylococcal infections is badly needed. One way of combating infections is preventing them by active immunisation. Vaccine development against *S. aureus* has been initiated by several research groups and national institutions worldwide, but there is no effective vaccine approved so far. It has been shown that an antibody-deficiency state contributes to staphylococcal persistence, suggesting that anti-staphylococcal antibodies are important in host defense. Antibodies—added as passive immunisation or induced by active vaccination—directed towards surface components could both prevent bacterial adherence, neutralize toxins and promote phagocytosis. A vaccine based on fibronectin binding protein induces protective immunity against mastitis in cattle and suggest that this approach is likely to work in humans (refs). Taking all this together it is suggestive that an effective vaccine should be composed of proteins or polypeptides, which are expressed by all strains and are able to induce high affinity, abundant antibodies against cell surface components of *S. aureus*. The antibodies should be IgG1 and/or IgG3 for opsonization, and any IgG subtype and IgA for neutralisation of adherence and toxin action. A chemically defined vaccine must be definitely superior compared to a whole cell vaccine (attenuated or killed), since components of *S. aureus* which paralyze TH cells (superantigens) or inhibit opsonization (protein A) can be eliminated, and the individual proteins inducing protective antibodies can be selected. Identification of the relevant antigens help to generate effective passive immunisation (humanised monoclonal antibody therapy), which can replace human immunoglobulin administration with all its dangerous side-effects. Neonatal staphylococcal infections, severe septicemia and other life-threatening acute conditions are the primary target of passive immunisation. An effective vaccine offers great potential for patients facing elective surgery in general, and those receiving endovascular devices, in particular. Moreover, patients suffering from chronic diseases which decrease immune responses or undergoing continuous ambulatory peritoneal dialysis are likely to benefit from such a vaccine.

For the illustrative example concerning *Staphylococcus aureus* three different approaches have been employed in parallel. All three of these methods are based on the interaction of *Staphylococcus* proteins or peptides with the antibodies present in human sera with the method according to the present invention. This interaction relies on the recognition of epitopes within the proteins which can be short peptides (linear epitopes) or polypeptide domains (structural epitopes). The antigenic proteins are identified by the different methods using pools of pre-selected sera and—in the second screening round—by individual selected sera.

Following the high throughput screening, the selected antigenic proteins are expressed as recombinant proteins or in vitro translated products (in case it can not be expressed in prokaryotic expression systems), and tested in a series of ELISA and Western blotting assays for the assessment of immunogeneicity with a large human serum collection (>100 uninfected, >50 patients sera). The preferred antigens are located on the cell surface or secreted, that is accessible extracellularly. Antibodies against the cell wall proteins (such as the Extracellular matrix binding proteins) are expected to serve double purposes: to inhibit adhesion and promote phagocytosis. The antibodies against the secreted proteins are beneficial in toxin neutralisation. It is also known that bacteria communicate with each other through secreted proteins. Neutralizing antibodies against these proteins will interrupt growth promoting cross-talk between or within staphylococcal species. Bioinformatics (signal sequences, cell wall localisation signals, transmembrane domains) proved to be very useful in assessing cell surface localisation or secretion. The experimental approach includes the isolation of antibodies with the corresponding epitopes and proteins from human serum, and use them as reagents in the following assays: cell surface staining of staphylococci grown under different conditions (FACS, microscopy), determination of neutralizing capacity (toxin, adherence), and promotion of opsonization and phagocytosis (in vitro phagocytosis assay).

The recognition of linear epitopes by antibodies can be based on sequences as short as 4-5 aa. Of course it does not necessarily mean that these short peptides are capable of inducing the given antibody. in vivo. For that reason the defined epitopes, polypeptides and proteins may further be tested in animals (mainly in mice) for their capacity to induce antibodies against the selected proteins in vivo. The antigens with the proven capability to induce antibodies will be tested in animal models for the ability to prevent infections.

The antibodies produced against Staphylococci by the human immune system and present in human sera are indicative of the in vivo expression of the antigenic proteins and their immunogenicity.

Accordingly, novel hyperimmune serum-reactive antigens from *Staphylococcus aureus* or *Staphylococcus epidermidis* have been made available by the method according to the present invention.

According to another aspect of the present invention the invention relates to a hyperimmune serum-reactive antigen selected from the group consisting of the sequences listed in any one of Tables 2a, 2b, 2c, 2d, 3, 4 and 5, especially selected from the group consisting of Seq. ID No. 56, 57, 59, 60, 67, 70, 72, 73, 74, 75, 76, 77, 78, 79, 80, 81, 82, 85, 87, 88, 89, 90, 92, 95, 96, 97, 99, 100, 101, 102, 103, 104, 106, 108, 110, 112, 114, 116, 118, 120, 122, 126, 128, 132, 134, 138, 140, 142, 151, 152, 154, 155 and hyperimmune fragments thereof. Accordingly, the present invention also relates to a hyperimmune serum-reactive antigen obtainable by the method according to the present invention and being selected from the group consisting of the sequences listed in any one of Tables 2a, 2b, 2c, 2d, 3, 4 and 5, especially selected from the group consisting of Seq. ID No. 56, 57, 59, 60, 67, 70, 72, 73, 74, 75, 76, 77, 78, 79, 80, 81, 82, 85, 87, 88, 89, 90, 92, 95, 96, 97, 99, 100, 101, 102, 103, 104, 106, 108, 110, 112, 114, 116, 118, 120, 122, 126, 128, 132, 134, 138, 140, 142, 151, 152, 154, 155 and hyperimmune fragments thereof.

Antigens from *Staphylococcus aureus* and *Staphylococcus epidermidis* have been extracted by the method according to the present invention which may be used in the manufacture of a pharmaceutical preparation, especially for the manufacture of a vaccine against *Staphylococcus aureus* and *Staphylococcus epidermidis* infections. Examples of such hyperimmune serum-reactive antigens of *Staphylococcus aureus* and *Staphylococcus epidermidis* to be used in a pharmaceutical preparation are selected from the group consisting of the sequences listed in any one of Tables 2a, 2b, 2c, 2d, 3, 4 and 5, especially selected from the group consisting of Seq. ID No. 55, 56, 57, 58, 59, 60, 62, 66, 67, 70, 71, 72, 73, 74, 75, 76, 77, 78, 79, 80, 81, 82, 83, 84, 85, 87, 88, 89, 90, 92, 94, 95, 96, 97, 99, 100, 101, 102, 103, 104, 106, 108, 110, 112, 114, 116, 118, 120, 122, 126, 128, 130, 132, 134, 138, 140, 142, 151, 152, 154, 155, 158 and hyperimmune fragments thereof for the manufacture of a pharmaceutical preparation, especially for the manufacture of a vaccine against *Staphylococcus aureus* and *Staphylococcus epidermidis* infections.

A hyperimmune fragment is defined as a fragment of the identified antigen which is for itself antigenic or may be made antigenic when provided as a hapten. Therefore, also antigen or antigenic fragments showing one or (for longer fragments) only a few amino acid exchanges are enabled with the present invention, provided that the antigenic capacities of such fragments with amino acid exchanges are not severely deteriorated on the exchange(s). i.e. suited for eliciting an appropriate immune response in a individual vaccinated with this antigen and identified by individual antibody preparations from individual sera.

Preferred examples of such hyperimmune fragments of a hyperimmune serum-reactive antigen are selected from the group consisting of peptides comprising the amino acid sequences of column "predicted immunogenic aa", "Location of identified immunogenic region" and "Serum reactivity with relevant region" of Tables 2a, 2b, 2c and 2d and the amino acid sequences of column "Putative antigenic surface areas" of Table 4 and 5, especially peptides comprising amino acid No. aa 12-29, 34-40, 63-71, 101-110, 114-122, 130-138, 140-195, 197-209, 215-229, 239-253, 255-274 and 39-94 of Seq. ID No. 55, aa 5-39, 111-117, 125-132, 134-141, 167-191, 196-202, 214-232, 236-241, 244-249, 292-297, 319-328, 336-341, 365-380, 385-391, 407-416, 420-429, 435-441, 452-461, 477-488, 491-498, 518-532, 545-556, 569-576, 581-587, 595-602, 604-609, 617-640, 643-651, 702-715, 723-731, 786-793, 805-811, 826-839, 874-889, 37-49, 63-77 and 274-334, of Seq. ID No. 56, aa 28-55, 82-100, 105-111, 125-131, 137-143, 1-49, of Seq. ID No. 57, aa 33-43, 45-51, 57-63, 65-72, 80-96, 99-110, 123-129, 161-171, 173-179, 185-191, 193-200, 208-224, 227-246, 252-258, 294-308, 321-329, 344-352, 691-707, 358-411 and 588-606, of Seq. ID No. 58, aa 16-38, 71-77, 87-94, 105-112, 124-144, 158-164, 169-177, 180-186, 194-204, 221-228, 236-245, 250-267, 336-343, 363-378, 385-394, 406-412, 423-440, 443-449, 401-494, of Seq. ID No. 59, aa 18-23, 42-55, 69-77, 85-98, 129-136, 182-188, 214-220, 229-235, 242-248, 251-258, 281-292, 309-316, 333-343, 348-354, 361-367, 393-407, 441-447, 481-488, 493-505, 510-515, 517-527, 530-535, 540-549, 564-583, 593-599, 608-621, 636-645, 656-670, 674-687, 697-708, 726-734, 755-760, 765-772, 785-792, 798-815, 819-824, 826-838, 846-852, 889-904, 907-913, 932-939, 956-964, 982-1000, 1008-1015, 1017-1024, 1028-1034, 1059-1065, 1078-1084, 1122-1129, 1134-1143, 1180-1186, 1188-1194, 1205-1215, 1224-1230, 1276-1283, 1333-1339, 1377-1382, 1415-1421, 1448-1459, 1467-1472, 1537-1545, 1556-1566, 1647-1654, 1666-1675, 1683-1689, 1722-1737, 1740-1754, 1756-1762, 1764-1773, 1775-1783, 1800-1809, 1811-1819, 1839-1851, 1859-1866, 1876-1882, 1930-1939, 1947-1954, 1978-1985, 1999-2007, 2015-2029, 2080-2086, 2094-2100, 2112-2118, 2196-2205, 2232-2243, 198-258, 646-727 and 2104-2206, of Seq. ID No. 60, aa 10-29, 46-56, 63-74, 83-105, 107-114, 138-145, 170-184, 186-193, 216-221, 242-248, 277-289, 303-311, 346-360, 379-389, 422-428, 446-453, 459-469, 479-489, 496-501, 83-156, of Seq. ID No. 62, aa 14-22, 32-40, 52-58, 61-77, 81-93, 111-117, 124-138, 151-190, 193-214, 224-244, 253-277, 287-295, 307-324, 326-332, 348-355, 357-362, 384-394, 397-434, 437-460, 489-496, 503-510, 516-522, 528-539, 541-547, 552-558, 563-573, 589-595, 602-624, 626-632, 651-667, 673-689, 694-706, 712-739, 756-790, 403-462, of Seq. ID No. 66, aa 49-56, 62-68, 83-89, 92-98, 109-115, 124-131, 142-159, 161-167, 169-175, 177-188, 196-224, 230-243, 246-252, 34-46, of Seq. ID No. 67, aa 11-20, 26-47, 69-75, 84-92, 102-109, 119-136, 139-147, 160-170, 178-185, 190-196, 208-215, 225-233, 245-250, 265-272, 277-284, 300-306, 346-357, 373-379, 384-390, 429-435, 471-481, 502-507, 536-561, 663-688, 791-816, 905-910, 919-933, 977-985, 1001-1010, 1052-1057, 1070-1077, 1082-1087, 1094-1112, 493-587, 633-715 and 704-760, of Seq. ID No. 70, aa. 6-20, 53-63, 83-90, 135-146, 195-208, 244-259, 263-314, 319-327, 337-349, 353-362, 365-374, 380-390, 397-405, 407-415, 208-287 and 286-314, of Seq. ID No. 71, aa 10-26, 31-43, 46-58, 61-66, 69-79, 85-92, 100-115, 120-126, 128-135, 149-155, 167-173, 178-187, 189-196, 202-222, 225-231, 233-240, 245-251, 257-263, 271-292, 314-322, 325-334, 339-345, 59-74, of Seq. ID No. 72, aa 4-9, 15-26, 65-76, 108-115, 119-128, 144-153, 38-52 and 66-114, of Seq. ID No. 73, aa 5-22, 42-50, 74-81, 139-145, 167-178, 220-230, 246-253, 255-264, 137-237 and 250-267, of Seq. ID No. 74, aa 10-26, 31-44, 60-66, 99-104, 146-153, 163-169, 197-205, 216-223, 226-238, 241-258, 271-280, 295-315, 346-351, 371-385, 396-407, 440-446, 452-457, 460-466, 492-510, 537-543, 546-551, 565-582, 590-595, 635-650, 672-678, 686-701, 705-712, 714-721, 725-731, 762-768, 800-805, 672-727, of Seq. ID No. 75, aa 5-32, 35-48, 55-76, of Seq. ID No. 76, aa 7-35, 54-59, 247-261, 263-272, 302-320, 330-339, 368-374, 382-411, 126-143 and 168-186, of Seq. ID No. 77, aa 5-24, 88-94, 102-113, 132-143, 163-173, 216-224, 254-269, 273-278, 305-313, 321-327, 334-341, 31-61 and 58-74, of Seq. ID No. 78, aa 16-24, 32-39, 43-49, 64-71, 93-99, 126-141, 144-156, 210-218, 226-233, 265-273, 276-284, 158-220, of Seq. ID No. 79, aa 49-72, 76-83, 95-105, 135-146, 148-164, 183-205, 57-128, of Seq. ID No. 80, aa 6-15, 22-32, 58-73, 82-88, 97-109, 120-131, 134-140, 151-163, 179-185, 219-230, 242-255, 271-277, 288-293, 305-319, 345-356, 368-381, 397-406, 408-420, 427-437, 448-454, 473-482, 498-505, 529-535, 550-563, 573-580, 582-590, 600-605, 618-627, 677-685, 718-725, 729-735, 744-759, 773-784, 789-794, 820-837, 902-908, 916-921, 929-935, 949-955, 1001-1008, 1026-1032, 1074-1083, 1088-1094, 1108-1117, 1137-1142, 1159-1177, 1183-1194, 1214-1220, 1236-1252, 1261-1269, 1289-1294, 1311-1329, 1336-1341, 1406-1413, 1419-1432, 1437-1457, 1464-1503, 1519-1525, 1531-1537, 1539-1557, 1560-1567, 1611-1618, 1620-1629, 1697-1704, 1712-1719, 1726-1736, 1781-1786, 1797-1817, 1848-1854, 1879-1890, 1919-1925, 1946-1953, 1974-1979, 5 to 134, of Seq. ID No. 81, aa 6-33, 40-46, 51-59, 61-77, 84-104, 112-118, 124-187, 194-248, 252-296, 308-325, 327-361, 367-393, 396-437, 452-479, 484-520, 535-545, 558-574, 582-614, 627-633, 656-663, 671-678, 698-704, 713-722, 725-742, 744-755, 770-784, 786-800, 816-822, 827-837, 483-511, of Seq. ID No. 82, aa 4-19, 57-70, 79-88, 126-132, 144-159, 161-167, 180-198, 200-212, 233-240, 248-255, 276-286, 298-304, 309-323, 332-346, 357-366, 374-391, 394-406, 450-456, 466-473, 479-487, 498-505, 507-519, 521-530, 532-540, 555-565, 571-581, 600-611, 619-625, 634-642, 650-656, 658-665, 676-682, 690-699, 724-733, 740-771, 774-784, 791-797, 808-815, 821-828, 832-838, 876-881, 893-906, 922-929, 938-943, 948-953, 969-976, 1002-1008, 1015-1035, 1056-1069, 1105-1116, 1124-1135, 1144-1151, 1173-1181, 1186-1191, 1206-1215, 1225-1230, 1235-1242, 6-66, 65-124 and 590-604, of Seq. ID No. 83, aa 5-32, 66-72, 87-98, 104-112, 116-124, 128-137, 162-168, 174-183, 248-254, 261-266, 289-303, 312-331, 174-249, of Seq. ID No. 84, aa 4-21, 28-40, 45-52, 59-71, 92-107, 123-137, 159-174, 190-202, 220-229, 232-241, 282-296, 302-308, 312-331, 21-118, of Seq. ID No. 85, aa 9-28, 43-48, 56-75, 109-126, 128-141, 143-162, 164-195, 197-216, 234-242, 244-251, 168-181, of Seq. ID No. 87, aa 4-10, 20-42, 50-86, 88-98, 102-171, 176-182, 189-221, 223-244, 246-268, 276-284, 296-329, 112-188, of Seq. ID No. 88, aa 4-9, 13-24, 26-34, 37-43, 45-51, 59-73, 90-96, 99-113, 160-173, 178-184, 218-228, 233-238, 255-262, 45-105, 103-166 and 66-153, of Seq. ID No. 89, aa 13-27, 42-63, 107-191, 198-215, 218-225, 233-250, 474-367, of Seq. ID No. 90;

aa 26-53, 95-123, 164-176, 189-199, 8-48, of Seq. ID No. 92, aa 7-13, 15-23, 26-33, 68-81, 84-90, 106-117, 129-137, 140-159, 165-172, 177-230, 234-240, 258-278, 295-319, 22-56, 23-99, 97-115, 233-250 and 245-265, of Seq. ID No. 94, aa 13-36, 40-49, 111-118, 134-140, 159-164, 173-183, 208-220, 232-241, 245-254, 262-271, 280-286, 295-301, 303-310, 319-324, 332-339, 1-85, 54-121 and 103-185, of Seq. ID No. 95, aa 39-44, 46-80, 92-98, 105-113, 118-123, 133-165, 176-208, 226-238, 240-255, 279-285, 298-330, 338-345, 350-357, 365-372, 397-402, 409-415, 465-473, 488-515, 517-535, 542-550, 554-590, 593-601, 603-620, 627-653, 660-665, 674-687, 698-718, 726-739, 386-402, of Seq. ID No. 96, aa 5-32, 34-49, 1-43, of Seq. ID No. 97, aa 10-27, 37-56, 64-99, 106-119, 121-136, 139-145, 148-178, 190-216, 225-249, 251-276, 292-297, 312-321, 332-399, 403-458, 183-200, of Seq. ID No. 99, aa 5-12, 15-20, 43-49, 94-106, 110-116, 119-128, 153-163, 175-180, 185-191, 198-209, 244-252, 254-264, 266-273, 280-288, 290-297, 63-126, of Seq. ID No. 100, aa 5-44, 47-55, 62-68, 70-78, 93-100, 128-151, 166-171, 176-308, 1-59, of Seq. ID No. 101, aa 18-28, 36-49, 56-62, 67-84, 86-95, 102-153, 180-195, 198-218, 254-280, 284-296, 301-325, 327-348, 353-390, 397-402, 407-414, 431-455, 328-394, of Seq. ID No. 102, aa 7-37, 56-71, 74-150, 155-162, 183-203, 211-222, 224-234, 242-272, 77-128, of Seq. ID No. 103, aa 34-58, 63-69, 74-86, 92-101, 130-138, 142-150, 158-191, 199-207, 210-221, 234-249, 252-271, 5-48, of Seq. ID No. 104, aa 12-36, 43-50, 58-65, 73-78, 80-87, 108-139, 147-153, 159-172, 190-203, 211-216, 224-232, 234-246, 256-261, 273-279, 286-293, 299-306, 340-346, 354-366, 167-181, of Seq. ID No. 106, aa 61-75, 82-87, 97-104, 113-123, 128-133, 203-216, 224-229, 236-246, 251-258, 271-286, 288-294, 301-310, 316-329, 337-346, 348-371, 394-406, 418-435, 440-452 of Seq. ID No. 112, aa 30-37, 44-55, 83-91, 101-118, 121-128, 136-149, 175-183, 185-193, 206-212, 222-229, 235-242 of Seq. ID No. 114, aa 28-38, 76-91, 102-109, 118-141, 146-153, 155-161, 165-179, 186-202, 215-221, 234-249, 262-269, 276-282, 289-302, 306-314, 321-326, 338-345, 360-369, 385-391 of Seq. ID No. 116, aa 9-33, 56-62, 75-84, 99-105, 122-127, 163-180, 186-192, 206-228, 233-240, 254-262, 275-283, 289-296, 322-330, 348-355, 416-424, 426-438, 441-452, 484-491, 522-528, 541-549, 563-569, 578-584, 624-641, 527-544, of Seq. ID No. 142, aa 37-42, 57-62, 121-135, 139-145, 183-190, 204-212, 220-227, 242-248, 278-288, 295-30, 304-309, 335-341, 396-404, 412-433, 443-449, 497-503, 505-513, 539-545, 552-558, 601-617, 629-649, 702-711, 736-745, 793-804, 814-829, 843-858, 864-885, 889-895, 905-913, 919-929, 937-943, 957-965, 970-986, 990-1030, 1038-1049, 1063-1072, 1080-1091, 1093-1116, 1126-1136, 1145-1157, 1163-1171, 1177-1183, 1189-1196, 1211-1218, 1225-1235, 1242-1256, 1261-1269, 624-684, of Seq. ID No. 151, aa 8-23, 31-38, 42-49, 61-77, 83-90, 99-108, 110-119, 140-147, 149-155, 159-171, 180-185, 189-209, 228-234, 245-262, 264-275, 280-302, 304-330, 343-360, 391-409, 432-437, 454-463, 467-474, 478-485, 515-528, 532-539, 553-567, 569-581, 586-592, 605-612, 627-635, 639-656, 671-682, 700-714, 731-747, 754-770, 775-791, 797-834, 838-848, 872-891, 927-933, 935-942, 948-968, 976-986, 1000-1007, 1029-1037, 630-700, of Seq. ID No. 152, aa 17-25, 27-55, 84-90, 95-101, 115-121, 55-101, of Seq. ID No. 154, aa 13-28, 40-46, 69-75, 86-92, 114-120, 126-137, 155-172, 182-193, 199-206, 213-221, 232-238, 243-253, 270-276, 284-290, 22-100, of Seq. ID No. 155 and aa 7-19, 46-57, 85-91, 110-117, 125-133, 140-149, 156-163, 198-204, 236-251, 269-275, 283-290, 318-323, 347-363, 9-42 and 158-174, of Seq. ID No. 158, aa 7-14, 21-30, 34-50, 52-63, 65-72, 77-84, 109-124, 129-152, 158-163, 175-190, 193-216, 219-234 of Seq. ID. No. 168, aa 5-24, 38-44, 100-106, 118-130, 144-154, 204-210, 218-223, 228-243, 257-264, 266-286, 292-299 of Seq. ID. No. 174, aa 29-44, 74-83, 105-113, 119-125, 130-148, 155-175, 182-190, 198-211, 238-245 of Seq. ID. No. 176, and fragments comprising at least 6, preferably more than 8, especially more than 10 aa of said sequences. All these fragments individually and each independently form a preferred selected aspect of the present invention.

Especially suited helper epitopes may also be derived from these antigens. Especially preferred helper epitopes are peptides comprising fragments selected from the peptides mentioned in column "Putative antigenic surface areas" in Tables 4 and 5 and from the group of aa 6-40, 583-598, 620-646 and 871-896 of Seq. ID. No. 56, aa 24-53 of Seq. ID. No. 70, aa 240-260 of Seq. ID. No. 74, aa 1660-1682 and 1746-1790 of Seq. ID. No. 81, aa 1-29, 680-709, and 878-902 of Seq. ID. No. 83, aa 96-136 of Seq. ID. No. 89, aa 1-29, 226-269 and 275-326 of Seq. ID. No. 94, aa 23-47 and 107-156 of Seq. ID. No. 114 and aa 24-53 of Seq. ID. No. 142 and fragments thereof being T-cell epitopes.

According to another aspect, the present invention relates to a vaccine comprising such a hyperimmune serum-reactive antigen or a fragment thereof as identified above for *Staphylococcus aureus* and *Staphylococcus epidermidis*. Such a vaccine may comprise one or more antigens against *S. aureus* or *S. epidermidis*. Optionally, such *S. aureus* or *S. epidermidis* antigens may also be combined with antigens against other pathogens in a combination vaccine. Preferably this vaccine further comprises an immunostimulatory substance, preferably selected from the group comprising polycationic polymers, especially polycationic peptides, immunostimulatory deoxynucleotides (ODNs), neuroactive compounds, especially human growth hormone, alumn, Freund's complete or incomplete adjuvans or combinations thereof. Such a vaccine may also comprise the antigen displayed on a surface display protein platform on the surface of a genetically engineered microorganism such as *E. coli*.

According to another aspect, the present invention relates to specific preparations comprising antibodies raised against at least one of the *Staphylococcus aureus* and *Staphylococcus epidermidis* antigens or *Staphylococcus aureus* and *Staphylococcus epidermidis* antigen fragments as defined above. These antibodies are preferably monoclonal antibodies.

Methods for producing such antibody preparations, polyclonal or monoclonal, are well available to the man skilled in the art and properly described in the prior art. A preferred method for producing such monoclonal antibody preparation is characterized by the following steps initiating an immune response in a non human animal by administering a *Staphylococcus* antigen or a fragment thereof, as defined above, to said animal, removing the spleen or spleen cells from said animal, producing hybridoma cells of said spleen or spleen cells, selecting and cloning hybridoma cells specific for said antigen and producing the antibody preparation by cultivation of said cloned hybridoma cells and optionally further purification steps.

Preferably, removing of the spleen or spleen cells is connected with killing said animal.

Monoclonal antibodies and fragments thereof can be chimerized or humanized (Graziano et al. 1995) to enable repeated administration. Alternatively human monoclonal antibodies and fragments thereof can be obtained from phage-display libraries (McGuinnes et al., 1996) or from transgenic animals (Bruggemann et al., 1996).

A preferred method for producing polyclonal antibody preparations to said *Staphylococcus aureus* or *Staphylococcus epidermidis* antigens identified with the present invention is characterized by the following steps initiating an immune response in a non human animal by administering a *Staphylococcus* antigen or a fragment thereof, as defined above, to said animal, removing an antibody containing body fluid from said animal, and producing the antibody preparation by subjecting said antibody containing body fluid to further purification steps.

These monoclonal or polyclonal antibody preparations may be used for the manufacture of a medicament for treating or preventing diseases due to staphylococcal infection. Moreover, they may be used for the diagnostic and imaging purposes.

The method is further described in the following examples and in the figures, but should not be restricted thereto.

Figure 3:
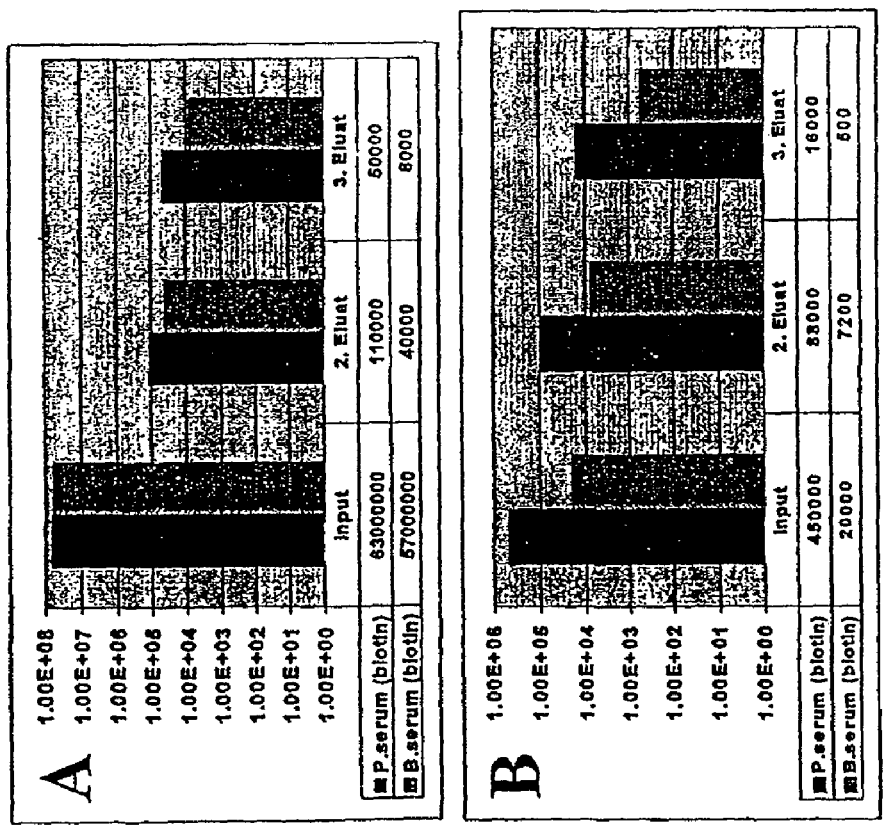

FIG. 3 shows the MACS selection with biotinylated human serum. The LSA50/6 library in pMAL9.1 was screened with 10 µg biotinylated, human serum in the first (A) and with 1 µg in the second selection round (B). P. serum, patient serum; B. serum, infant serum. Number of cells selected after the $2^{nd}$ and $3^{rd}$ elution are shown for each selection round.

Figure 4:
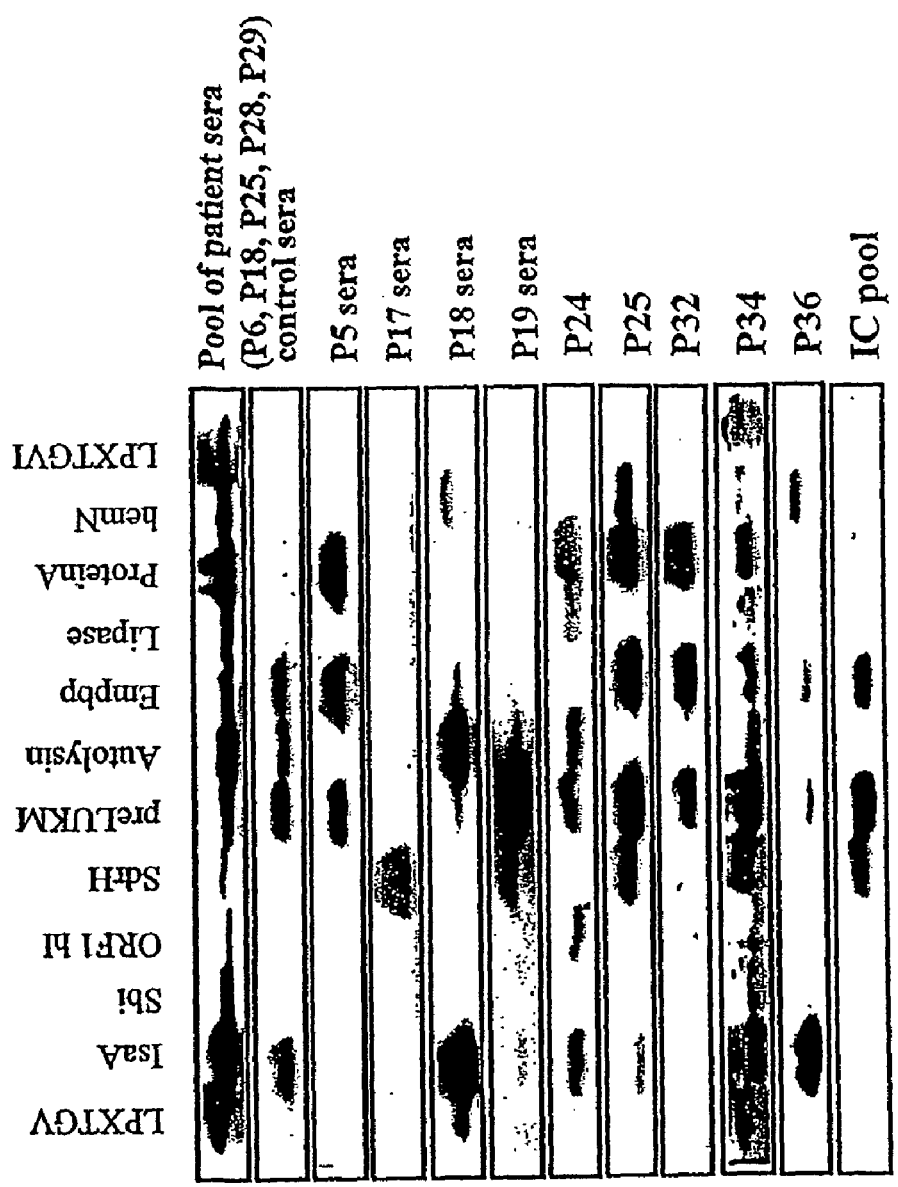

FIG. 4 shows the serum reactivity with specific clones isolated by bacterial surface display as analyzed by Western blot analysis with patient serum at a dilution of 1:5000.

Figure 5:
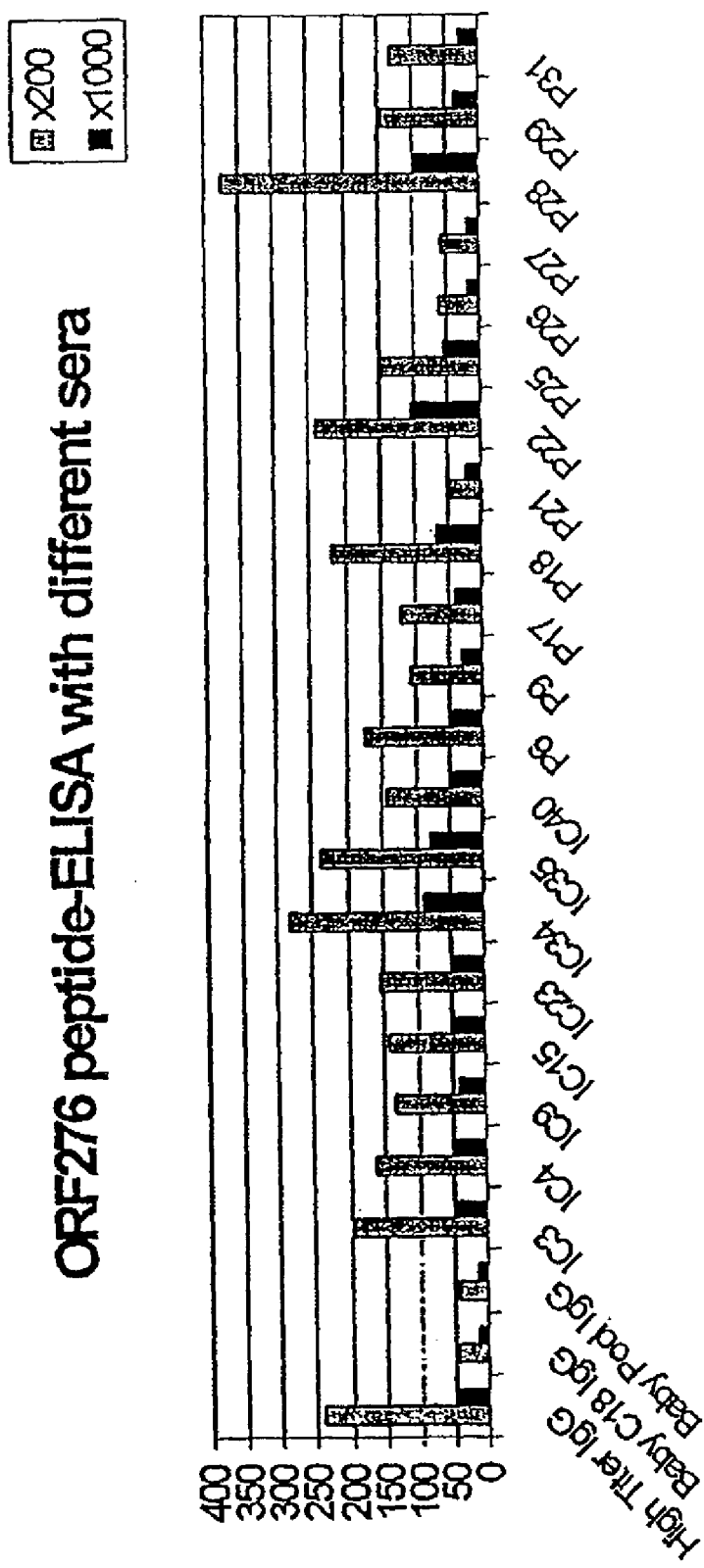

FIG. 5 shows peptide ELISA with serum from patients and healthy individuals with an epitope identified by ribosome display.

Figure 6:
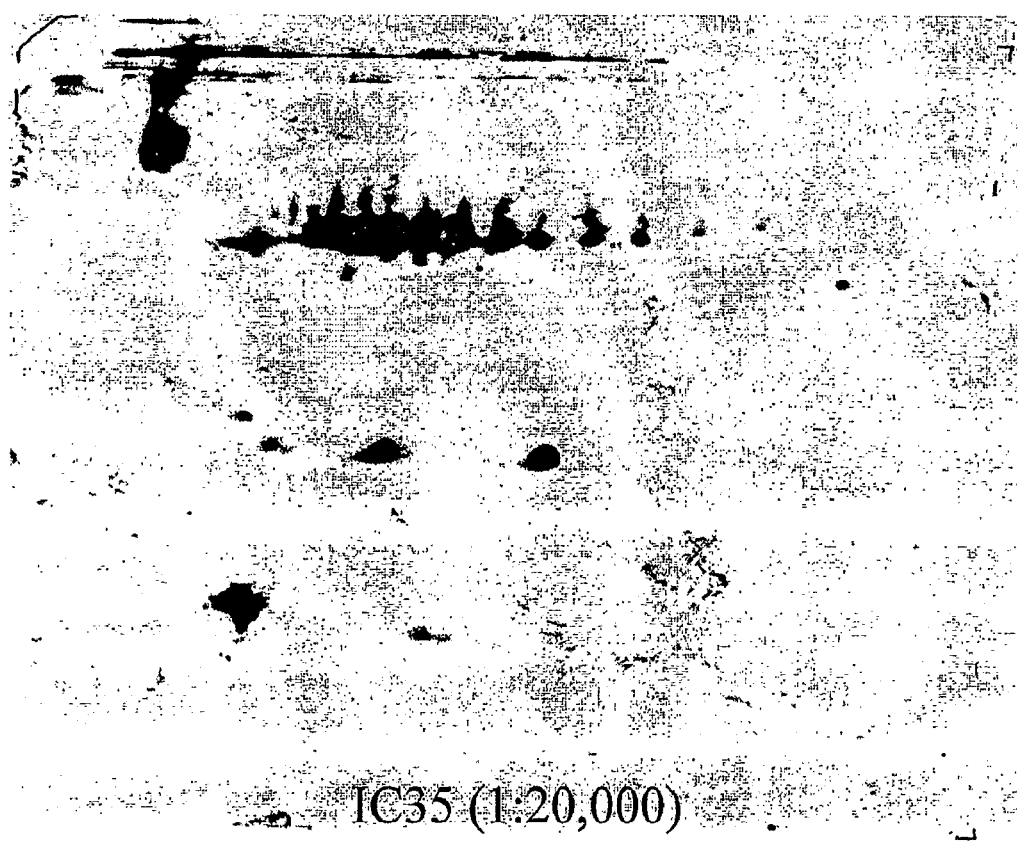

FIG. 6 shows representative 2D Immunoblot of *S. aureus* surface proteins detected with human sera. 800 µg protein from *S. aureus*/COL grown on BHI were resolved by IEF (pI 4-7) and SDS-PAGE (9-16%), and subsequently transferred to PVDF membrane. After blocking, the membrane was incubated with sera IC35 (1:20,000). Binding of serum IgG was visualized by an anti-human IgG/HRPO conjugate and ECL development.

Figure 7:
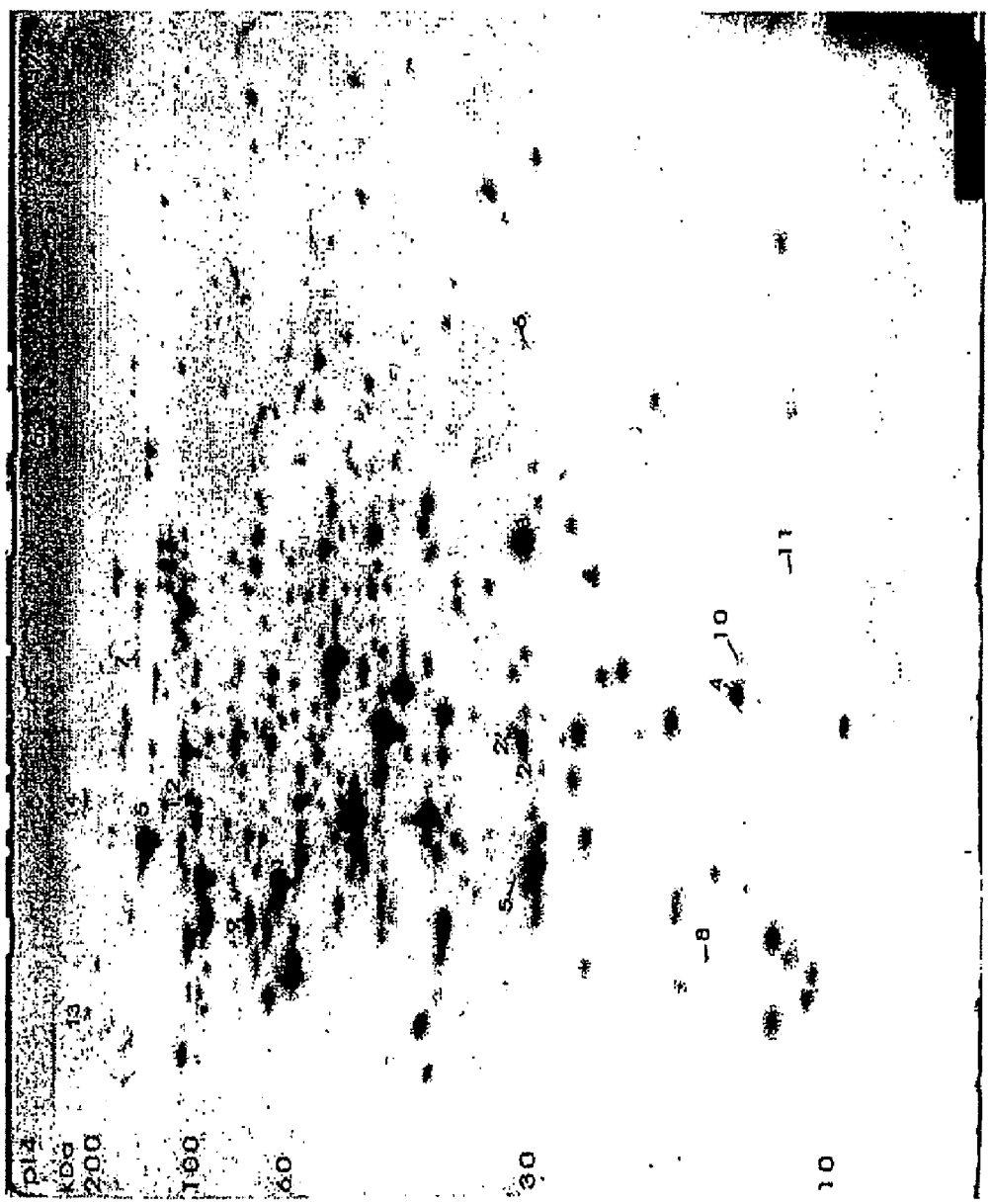

FIG. 7 demonstrates a representative 2D gel showing *S. aureus* surface proteins stained by Coomassie Blue. 1 mg protein from *S. aureus*/COL were resolved by IEF (pI 4-7) and SDS-PAGE (9-16%). Spots selected for sequencing after serological proteome analysis are marked.

FIGS. 8A and 8B show the structure of LPXTG (SEQ ID NO:641) cell wall proteins (SEQ ID NOS:604 through 638 639).

Figure 9:
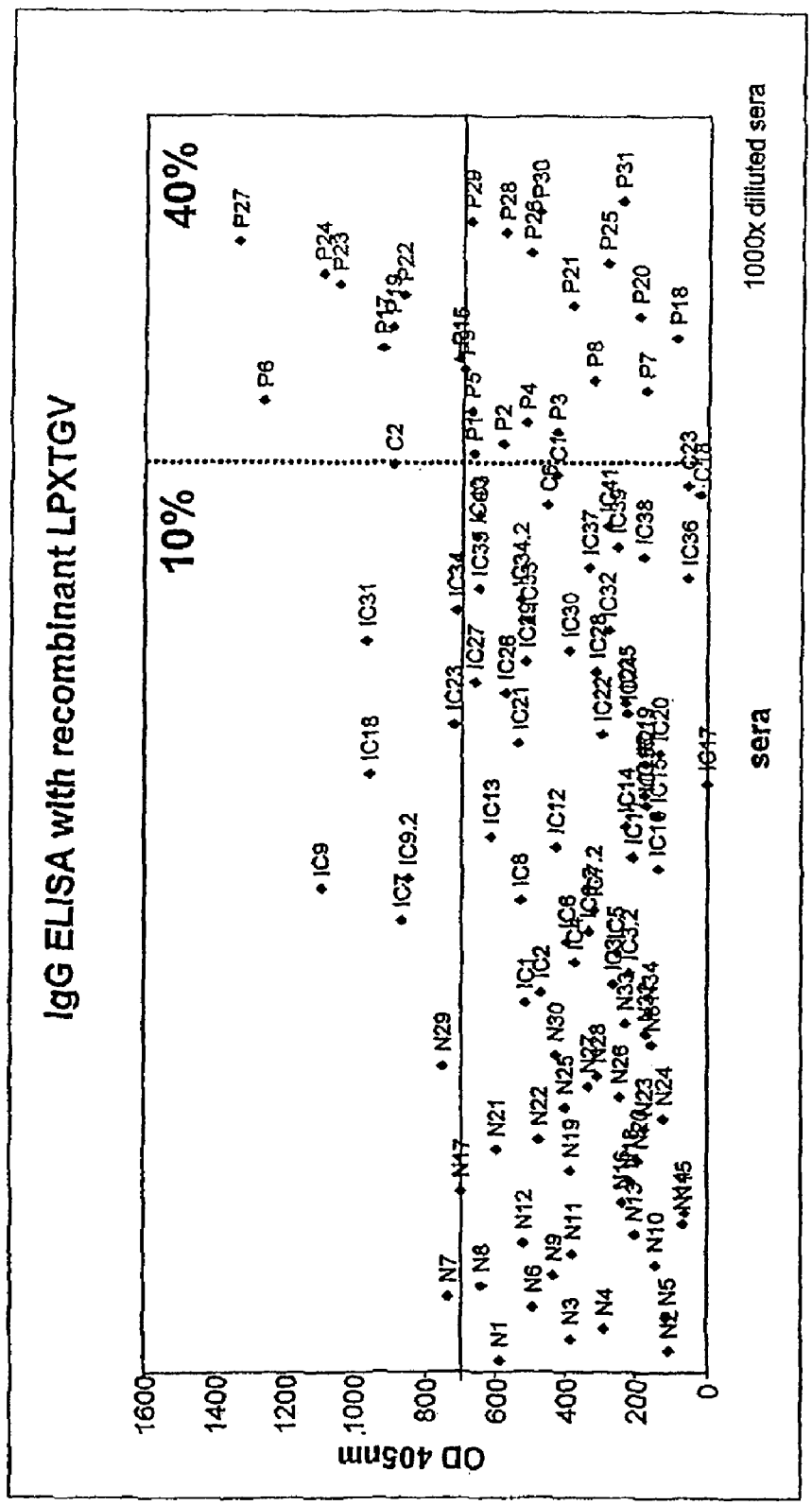
Figure 10:
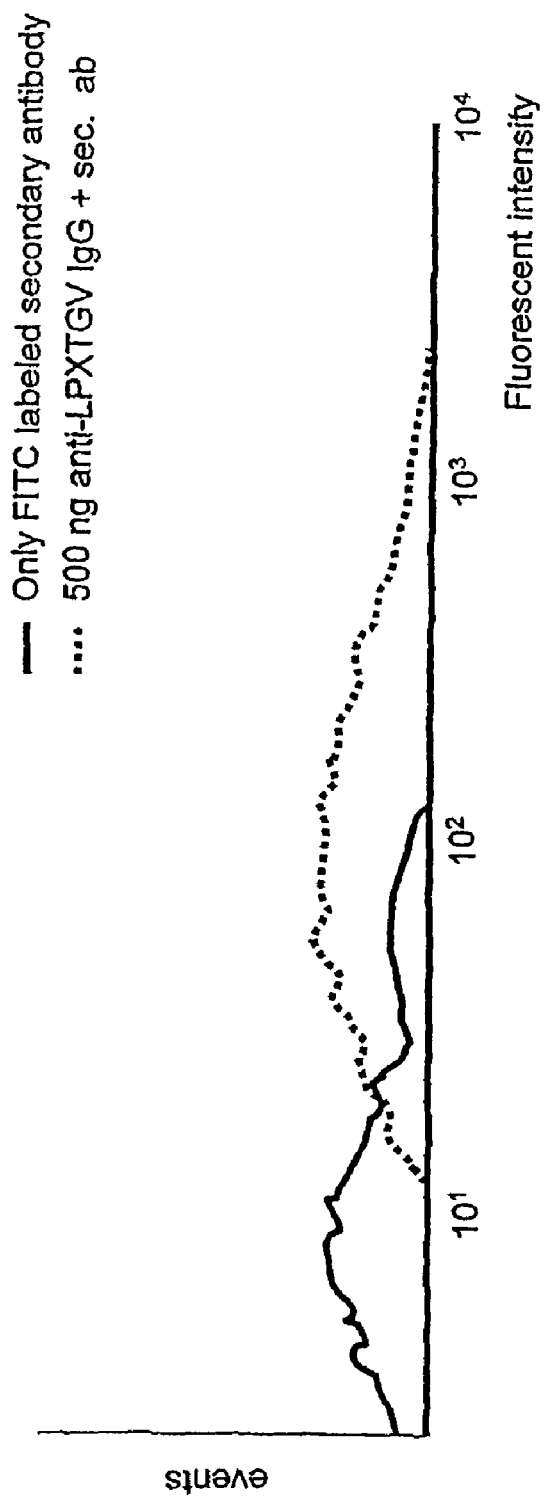

FIG. 9 shows the IgG response in uninfected (N, C) and infected (P) patients to LPXTGV (SEQ ID NO:640), a novel antigen and probable surface adhesin of *S. aureus*, discovered by both the inventive bacterial FIG. 10 shows the surface staining of *S. aureus* with purified anti-LPXTGV (SEQ ID NO:640) IgGs.

FIG. 11 shows a 2D gel where *S. aureus* surface proteins are stained by Coomassie Blue (left). 1 mg protein from *S. aureus*/agr grown to early log phase was resolved by IEF (pI 6-11) and SDS-PAGE (9-16%). Spots selected for sequencing after serological proteome analysis are marked. Corresponding 2D-immunoblot (right). 800 µg protein from the same preparation was resolved in parallel by 2DE, and subsequently transferred to PVDF membrane. After blocking, the membrane was incubated with the P-pool (1:10,000). Binding of serum IgG was visualized by an anti-human IgG/HRPO conjugate and ECL development.

EXAMPLES

Discovery of Novel *Staphyloccocus aureus* Antigens

Example 1

Preparation of Antibodies from Human Serum

The antibodies produced against staphylococci by the human immune system and present in human sera are indicative of the in vivo expression of the antigenic proteins and their immunogenicity. These molecules are essential for the identification of individual antigens in the approach as the present invention which is based on the interaction of the specific anti-staphylococcal antibodies and the corresponding *S. aureus* peptides or proteins. To gain access to relevant antibody repertoires, human sera were collected from I. patients with acute *S. aureus* infections, such as bacteriaemia, sepsis, infections of intravascular and percutan catheters and devices, wound infections, and superficial and deep soft tissue infection. *S. aureus* was shown to be the causative agent by medical microbiological tests. II. A collection of serum samples from uninfected adults was also included in the present analysis, since staphylococcal infections are common, and antibodies are present as a consequence of natural immunization from previous encounters with Staphylococci from skin and soft tissue infections (furunculus, wound infection, periodontitits etc.).

The sera were characterized for *S. aureus* antibodies by a series of ELISA assays. Several styaphylococcal antigens have been used to prove that the titer measured was not a result of the sum of cross-reactive antibodies. For that purpose not only whole cell *S. aureus* (protein A deficient) extracts (grown under different conditions) or whole bacteria were used in the ELISA assays, but also individual cell wall components, such as lipoteichoic acid and peptidoglycan isolated from *S. aureus*. More importantly, a recombinant protein collection was established representing known staphylococcal cell surface proteins for the better characterization of the present human sera collections.

Recently it was reported that not only IgG, but also IgA serum antibodies can be recognized by the FcRIII receptors of PMNs and promote opsonization (Phillips-Quagliata et al., 2000; Shibuya et al., 2000). The primary role of IgA antibodies is neutralization, mainly at the mucosal surface. The level of serum IgA reflects the quality, quantity and specificity of the dimeric secretory IgA. For that reason the serum collection was not only analyzed for anti-staphylococcal IgG, but also for IgA levels. In the ELISA assays highly specific secondary reagents were used to detect antibodies from the high affinity types, such as IgG and IgA, and avoided IgM. Production of IgM antibodies occurs during the primary adaptive humoral response, and results in low affinity antibodies, while IgG and IgA antibodies had already undergone affinity maturation, and are more valuable in fighting or preventing disease Experimental Procedures Enzyme linked immune assay (ELISA). ELISA plates were coated with 2-10 µg/ml of the different antigens in coating buffer (sodium carbonate pH 9.2). Serial dilutions of sera (100-100.000) were made in TBS-BSA. Highly specific (cross-adsorbed) HRP (Horse Radish Peroxidase)-labeled anti-human IgG or anti-human IgA secondary antibodies (Southern Biotech) were used according to the manufacturers' recommendations (~2.000×). Antigen-antibody complexes were quantified by measuring the conversion of the substrate (ABTS) to colored product based on $OD_{405nm}$ readings in an automated ELISA reader (Wallace Victor 1420). The titers were compared at given dilution where the dilution response was linear (Table 1). The ~100 sera were ranked based on the reactivity against multiple staphylococcal components, and the highest ones (above 90 percentile) were selected for further analysis in antigen identification. Importantly, the anti-staphylococcal antibodies from sera of clinically healthy individuals proved to be very stable, giving the same high ELISA titers against all the staphylococcal antigens measured after 3, 6 and 9 months (data not shown). In contrast, anti-*S. aureus* antibodies in patients decrease, then disappear after a couple of weeks following the infection (Coloque-Navarro et al, 1998). However, antibodies from patients are very important, since these are direct proof of the in vivo expression of the bacterial antigens tested in or ELISAs or identified as immunogenic during the screens according to the present invention.

This comprehensive approach followed during antibody characterization is unique, and led to unambiguous identification of anti-staphylococcal hyperimmune sera.

Purification of antibodies for genomic screening. Five sera from both the patient and the noninfected group were selected based on the overall anti-staphylococcal titers. Antibodies against *E. coli* proteins were removed by either incubating the heat inactivated sera with whole cell *E. coli* (DH5a, transformed with pHIE11, grown under the same condition as used for bacterial display) or with *E. coli* lysate affinity chromatography for ribosome display. Highly enriched preparations of IgG from the pooled, depleted sera were generated by protein G affinity chromatography, according to the manufacturer's instructions (UltraLink Immobilized Protein G, Pierce). IgA antibodies were purified also by affinity chromatography using biotin-labeled anti-human IgA (Southern Biotech) immobilized on Streptavidin-agarose (GIBCO BRL). The efficiency of depletion and purification was checked by SDS-PAGE, Western blotting, ELISA, and protein concentration measurements. For proteomics, the depletion the IgG and IgA preparation was not necessary, since the secondary reagent ensured the specificity.

Example 2

Generation of Highly Random, Frame-Selected, Small-Fragment, Genomic DNA Libraries of *Staphylococcus aureus*

Experimental Procedures

Preparation of staphylococcal genomic DNA. This method was developed as a modification of two previously published protocols (Sohail, 1998, Betley et al., 1984) and originally specifically adapted for the methicillin resistant *Staphylococcus aureus* strain COL to obtain genomic DNA in high quality and large scale. 500 ml BHI (Brain Heart Infusion) medium supplemented with 5 µg/ml Tetracycline was inoculated with bacteria from a frozen stab and grown with aeration and shaking for 18 h at 37°. The culture was then harvested in two aliquots of 250 ml each, centrifuged with 1600×g for 15 min and the supernatant was removed. Bacterial pellets were carefully re-suspended in 26 ml of 0.1 mM Tris-HCl, pH 7.6 and centrifuged again with 1600×g for 15 min. Pellets were re-suspended in 20 ml of 1 mM Tris-HCl, pH 7.6, 0.1 mM EDTA and transferred into sterile 50 ml polypropylene tubes. 1 ml of 10 mg/ml heat treated RNase A and 200 U of RNase T1 were added to each tube and the solution mixed carefully. 250 µl of Lysostaphin (10 mg/ml stock, freshly prepared in ddH$_2$O) was then added to the tubes, mixed thoroughly and incubated at 40° C. for 10 min in a shaking water bath under continuous agitation. After the addition of 1 ml 10% SDS, 40 µl of Proteinase K (25 mg/ml stock) and 100 µl of Pronase (10 mg/ml), tubes were again inverted several times and incubated at 40° C. for 5 min in a shaking water bath. 3.75 ml of 5 M NaCl and 2.5 ml of cetyl trimethyl-ammonium bromide solution (CTAB) (10% w/v, 4% w/v NaCl) were then added and tubes were further incubated at 65° C. in a shaking water bath for 10 min. Samples were cooled to room temperature and extracted with PhOH/CHCl$_3$/IAA (25:24:1) and with CHCl$_3$/IAA (24:1). Aqueous phases were carefully collected and transferred to new sterile 50-ml tubes. To each tube 1.5 ml of Strataclean™ Resin was added, mixed gently but thoroughly and incubated for one minute at room temperature. Samples were centrifuged and the upper layers containing the DNA were collected into clean 50 ml-tubes. DNA was precipitated at room temperature by adding 0.6× volume of Isopropanol, spooled from the solution with a sterile Pasteur pipette and transferred into tubes containing 80% ice cold ethanol. DNA was recovered by centrifuging the precipitates with 10-12.000×g, then dried on air and dissolved in ddH$_2$O.

Preparation of small genomic DNA fragments. Genomic DNA fragments were mechanically sheared into fragments ranging in size between 150 and 300 bp using a cup-horn sonicator (Bandelin Sonoplus UV 2200 sonicator equipped with a BB5 cup horn, 10 sec. pulses at 100% power output) or into fragments of size between 50 and 70 bp by mild DNase I treatment (Novagen). It was observed that sonication yielded a much tighter fragment size distribution when breaking the DNA into fragments of the 150-300 bp size range. However, despite extensive exposure of the DNA to ultrasonic wave-induced hydromechanical shearing force, subsequent decrease in fragment size could not be efficiently and reproducibly achieved. Therefore, fragments of 50 to 70 bp in size were obtained by mild DNase I treatment using Novagen's shotgun cleavage kit. A 1:20 dilution of DNase I provided with the kit was pre-pared and the digestion was performed in the presence of MnCl$_2$ in a 60 µl volume at 20° C. for 5 min to ensure double-stranded cleavage by the enzyme. Reactions were stopped with 2 µl of 0.5 M EDTA and the fragmentation efficiency was evaluated on a 2% TAE-agarose gel. This treatment resulted in total fragmentation of genomic DNA into near 50-70 bp fragments. Fragments were then blunt-ended twice using T4 DNA Polymerase in the presence of 100 µM each of dNTPs to ensure efficient flushing of the ends. Fragments were used immediately in ligation reactions or frozen at −20° C. for subsequent use.

Description of the vectors. The vector pMAL4.1 was constructed on a pEH1 backbone (Hashemzadeh-Bonehi et al., 1998) with the Kanamycin resistance gene. In addition it harbors a b-lactamase (bla) gene cloned into the multiple cloning site. The bla gene is pre-ceded by the leader peptide sequence of ompA to ensure efficient secretion across the cytoplasmic membrane. A Sma I restriction site serves for library insertion. The Sma I site is flanked by an upstream FseI site and a downstream NotI site which were used for recovery of the selected fragments. The three restriction sites are inserted after the ompA leader sequence in such a way that the bla gene is transcribed in the −1 reading frame resulting in a stop codon 15 bp after the NotI site. A +1 bp insertion restores the bla ORF so that b-lactamase protein is produced with a consequent gain of Ampicillin resistance.

The vector pMAL4.31 was constructed on a pASK-IBA backbone (Skerra, 1994) with the b-lactamase gene exchanged with the Kanamycin resistance gene. In addition it harbors a b-lactamase (bla) gene cloned into the multiple cloning site. The sequence encoding mature b-lactamase is preceded by the leader peptide sequence of ompA to allow efficient secretion across the cytoplasmic membrane. Furthermore a sequence encoding the first 12 amino acids (spacer sequence) of mature b-lactamase follows the ompA leader peptide sequence to avoid fusion of sequences immediately after the leader peptidase cleavage site, since e.g. clusters of positive charged amino acids in this region would decrease or abolish translocation across the cytoplasmic membrane (Kajava et al., 2000). A SmaI restriction site serves for library insertion. The SmaI site is flanked by an upstream FseI site and a down-stream NotI site which were used for recovery of the selected fragment. The three restriction sites are inserted after the sequence encoding the 12 amino acid spacer sequence in such a way that the bla gene is transcribed in the −1 reading frame resulting in a stop codon 15 bp after the NotI site. A +1 bp insertion restores the bla ORF so that b-lactamase protein is produced with a consequent gain of Ampicillin resistance.

The vector pMAL9.1 was constructed by cloning the lamB gene into the multiple cloning site of pEH1. Subsequently, a sequence was inserted in lamB after amino acid 154, containing the restriction sites FseI, SmaI and NotI. The reading frame for this insertion was chosen in a way that transfer of frame-selected DNA fragments excised by digestion with FseI and NotI from plasmids pMAL4.1 or pMAL4.31 to plasmid pMAL9.1 will yield a continuous reading frame of lamB and the respective insert.

The vector pHIE11 was constructed by cloning the fhuA gene into the multiple cloning site of pEH1. Thereafter, a sequence was inserted in fhuA after amino acid 405, containing the restriction site FseI, XbaI and NotI. The reading frame for this insertion was chosen in a way that transfer of frame-selected DNA fragments excised by digestion with FseI and NotI from plasmids pMAL4.1 or pMAL4.31 to plasmid pHIE11 will yield a continuous reading frame of fhuA and the respective insert.

Cloning and evaluation of the library for frame selection. Genomic S. aureus DNA fragments were ligated into the SmaI site of either the vector pMAL4.1 or pMAL4.31. Recombinant DNA was electroporated into DH10B electro-competent E. coli cells (GIBCO BRL) and transformants plated on LB-agar supplemented with Kanamycin (50 µg/ml) and Ampicillin (50 µg/ml). Plates were incubated over night at 37° C. and colonies collected for large scale DNA extraction. A representative plate was stored and saved for collecting colonies for colony PCR analysis and large-scale sequencing. A simple colony PCR assay was used to initially determine the rough fragment size distribution as well as insertion efficiency. From sequencing data the precise fragment size was evaluated, junction intactness at the insertion site as well as the frame selection accuracy (3n+1 rule).

Cloning and evaluation of the library for bacterial surface display. Genomic DNA fragments were excised from the pMAL4.1 or pMAL4.31 vector, containing the S. aureus library with the restriction enzymes FseI and NotI. The entire population of fragments was then transferred into plasmids pMAL9.1 (LamB) or pHIE11 (FhuA) which have been digested with FseI and NotI. Using these two restriction enzymes, which recognise an 8 bp GC rich sequence, the reading frame that was selected in the pMAL4.1 or pMAL4.31 vector is maintained in each of the platform vectors. The plasmid library was then transformed into E. coli DH5a cells by electroporation. Cells were plated onto large LB-agar plates supplemented with 50 µg/ml Kanamycin and grown over night at 37° C. at a density yielding clearly visible single colonies. Cells were then scraped off the surface of these plates, washed with fresh LB medium and stored in aliquots for library screening at −80° C.

Results

Figure 1:
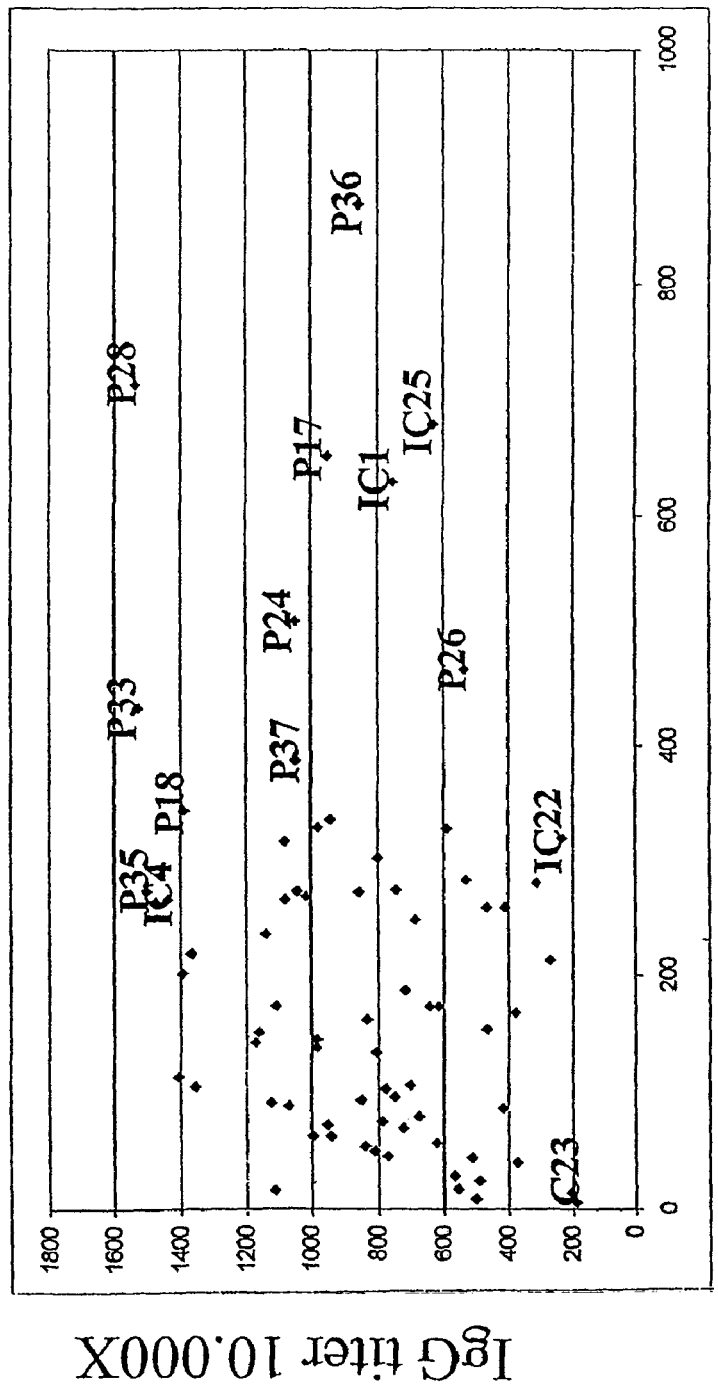
FIG. 1 shows the pre-selection of sera based on anti-staphylococcal antibody titers measured by ELISA.
Figure 2:
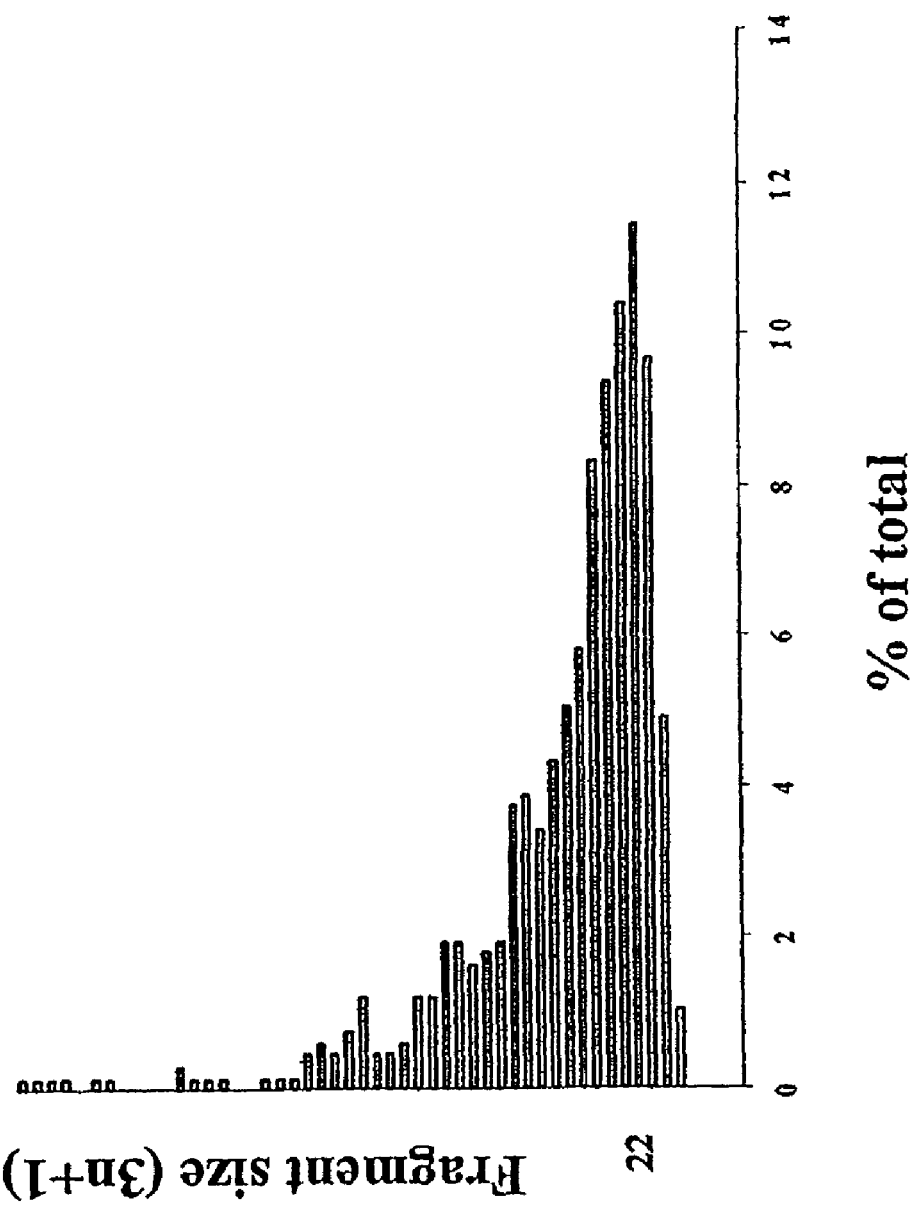
FIG. 2 shows the size distribution of DNA fragments in the LSA50/6 library in pMAL4.1.

Libraries for frame selection. Two libraries (LSA50/6 and LSA250/1) were generated in the pMAL4.1 vector with sizes of approximately 50 and 250 bp, respectively. For both libraries a total number of clones after frame selection of $1-2\times10^6$ was received using approximately 1 µg of pMAL4.1 plasmid DNA and 50 ng of fragmented genomic S. aureus DNA. To assess the randomness of the LSA50/6 library, 672 randomly chosen clones were sequenced. The bioinformatic analysis showed that of these clones none was present more than once. Furthermore, it was shown that 90% of the clones fell in the size range of 19 to 70 bp with an average size of 25 bp (FIG. 2). All 672 sequences followed the 3n+1 rule, showing that all clones were properly frame selected.

Bacterial surface display libraries. The display of peptides on the surface of E. coli required the transfer of the inserts from the LSA50/6 library from the frame selection vector pMAL4.1 to the display plasmids pMAL9.1 (LamB) or pHIE11 (FhuA). Genomic DNA fragments were excised by FseI and NotI restriction and ligation of 5 ng inserts with 0.1 µg plasmid DNA resulted in $2-5\times10^6$ clones. The clones were scraped off the LB plates and frozen without further amplification.

Example 3

Identification of Highly Immunogenic Peptide Sequences from S. aureus Using Bacterial Surface Displayed Genomic Libraries and Human Serum Experimental Procedures MACS screening. Approximately $2.5\times10^8$ cells from a given library were grown in 5 ml LB-medium supplemented with 50 µg/ml Kanamycin for 2 h at 37° C. Expression was induced by the addition of 1 mm IPTG for 30 min. Cells were washed twice with fresh LB medium and approximately $2\times10^7$ cells re-suspended in 100 µl LB medium and transferred to an Eppendorf tube.

10 µg of biotinylated, human serum was added to the cells and the suspension incubated over night at 4° C. with gentle shaking. 900 µl of LB medium was added, the suspension mixed and subsequently centrifuged for 10 min at 6000 rpm at 4° C. Cells were washed once with 1 ml LB and then re-suspended in 100 µl LB medium. 10 µl of MACS microbeads coupled to streptavidin (Miltenyi Biotech, Germany) were added and the incubation continued for 20 min at 4° C. Thereafter 900 µl of LB medium was added and the MACS microbead cell suspension was loaded onto the equilibrated MS column (Miltenyi Biotech, Germany) which was fixed to the magnet. (The MS columns were equilibrated by washing once with 1 ml 70% EtOH and twice with 2 ml LB medium.)

The column was then washed three times with 3 ml LB medium. The elution was performed by removing the magnet and washing with 2 ml LB medium. After washing the column with 3 ml LB medium, the 2 ml eluate was loaded a second time on the same column and the washing and elution process repeated. The loading, washing and elution process was performed a third time, resulting in a final eluate of 2 ml.

A second round of screening was performed as follows. The cells from the final eluate were collected by centrifugation and re-suspended in 1 ml LB medium supplemented with 50 µg/ml Kanamycin. The culture was incubated at 37° C. for 90 min and then induced with 1 mM IPTG for 30 min. Cells were subsequently collected, washed once with 1 ml LB medium and suspended in 10 µl LB medium. Since the volume was reduced, 1 µg of human, biotinylated serum was added and the suspension incubated over night at 4° C. with gentle shaking. All further steps were exactly the same as in the first selection round. Cells selected after two rounds of selection were plated onto LB-agar plates supplemented with 50 µg/ml Kanamycin and grown over night at 37° C.

Evaluation of selected clones by sequencing and Western blot analysis. Selected clones were grown over night at 37° C. in 3 ml LB medium supplemented with 50 µg/ml Kanamycin to prepare plasmid DNA using standard procedures. Sequencing was performed at MWG (Germany) or in a collaboration with TIGR (U.S.A.).

For Western blot analysis approximately 10 to 20 µg of total cellular protein was separated by 10% SDS-PAGE and blotted onto HybondC membrane (Amersham Pharmacia Biotech, England). The LamB or FhuA fusion proteins were detected using human serum as the primary antibody at a dilution of 1:5000 and anti human IgG antibodies coupled to HRP at a dilution of 1:5000 as secondary antibodies. Detection was performed using the ECL detection kit (Amersham Pharmacia Biotech, England). Alternatively, rabbit anti FhuA or mouse anti LamB antibodies were used as primary antibodies in combination with the respective secondary antibodies coupled to HRP for the detection of the fusion proteins.

Results

Screening of bacterial surface display libraries by magnetic activated cell sorting (MACS) using biotinylated human serum. The libraries LSA50/6 in pMAL9.1 and LSA250/1 in pHIE11 were screened with a pool of biotinylated, human patient sera (see Example 1) Preparation of antibodies from human serum). The selection procedure was performed as described under Experimental procedures. As a control, pooled human sera from infants that have most likely not been infected with S. aureus was used. Under the described conditions between 10 and 50 fold more cells with the patient compared to the infant serum were routinely selected (FIG. 3). To evaluate the performance of the screen, approximately 100 selected clones were picked randomly and subjected to Western blot analysis with the same pooled patient serum. This analysis revealed that 30 to 50% of the selected clones showed reactivity with antibodies present in patient serum whereas the control strain expressing LamB or FhuA without a S. aureus specific insert did not react with the same serum. Colony PCR analysis showed that all selected clones contained an insert in the expected size range.

Subsequent sequencing of a larger number of randomly picked clones (500 to 800 per screen) led to the identification of the gene and the corresponding peptide or protein sequence that was specifically recognized by the human patient serum used for screening. The frequency with which a specific clone is selected reflects at least in part the abundance and/or affinity of the specific antibodies in the serum used for selection and recognizing the epitope presented by this clone. In that regard it is striking that some clones (ORF2264, ORF1951, ORF0222, lipase and IsaA) were picked up to 90 times, indicating their highly immunogenic property. All clones that are presented in Table 2 have been verified by Western blot analysis using whole cellular extracts from single clones to show the indicated reactivity with the pool of human serum used in the screen.

It is further worth noticing that most of the genes identified by the bacterial surface display screen encode proteins that are either attached to the surface of S. aureus and/or are secreted. This is in accordance with the expected role of surface attached or secreted proteins in virulence of S. aureus.

Assessment of reactivity of highly immunogenic peptide sequences with different human sera. 10 to 30 different human patient sera were subsequently used to evaluate the presence of antibodies against the selected immunogenic peptide sequences that have been discovered in the screen according to the present invention. To eliminate possible cross-reactivity with proteins expressed by E. coli, all sera were pre-adsorbed with a total cellular lysate of E. coli DHa cells expressing FhuA protein.

This analysis is summarized in Table 2 and as an example shown in FIG. 4 and is indicative of the validity of the present screen. It further shows that already short selected epitopes can give rise to the production of antibodies in a large number of patients (ORF1618, ORF1632, IsaA, Empbp, Protein A). Those peptide sequences that are not recognized by a larger set of patient sera may still be part of an highly immunogenic protein, but the recombinant protein itself may be tested for that purpose for each single case.

Example 4

Identification of Highly Immunogenic Peptide Sequences from Genomic Fragments from S. aureus Using Ribosome Display and Human Serum Experimental Procedures Ribosome display screening: 2.4 ng of the genomic library from S. aureus LSA 250/1 in pMAL4.1 (described above) was PCR amplified with oligos ICC277 and ICC202 in order to be used for ribosome display. Oligos ICC277 (CGAATAATACGACTCACTATAGGGAGAC-CACAACGGTTTCCCACTAGTAATAATTT TGTT-TAACTTTAAGAAGGAGATATATCCATGCAGACCTTG-GCCGGCCTCCC—SEQ ID NO:600) and ICC202 (GGC-CCACCCGTGAAGGTGAGCCGGCGTAAGATGCTT-TTCTGTGACTGG—SEQ ID NO:601) hybridize 5' and 3' of the Fse I-Not I insertion site of plasmid pMAL4.1, respectively. ICC277 introduces a T7 phage RNA polymerase promoter, a palindromic sequence resulting in a stem-loop structure on the RNA level, a ribosome binding site (RBS) and the translation start of gene 10 of the T7 phage including the ATG start codon. Oligo ICC202 hybridizes at nucleotide position 668 of the β-lactamase open reading frame and also introduces a stem-loop structure at the 3' end of the resulting RNA. PCR was performed with the High fidelity PCR kit (Roche Diagnostic) for 25 cycles at 50° C. hybridization temperature and otherwise standard conditions.

The resulting PCR library was used in 5 consecutive rounds of selection and amplification by ribosome display similar as described previously (Hanes et al., 1997) but with modifications as described below.

One round of ribosome display contained the following steps: In vitro transcription of 2 µg PCR product with the RiboMax kit (Promega) resulted in ca. 50 µg RNA. In vitro translation was performed for 9 minutes at 37° C. in 22 µl volume with 4.4 µl Premix Z (250 mM TRIS-acetate pH 7.5, 1.75 mM of each amino acid, 10 mM ATP, 2.5 mM GTP, 5 mM cAMP, 150 mM acetylphosphate, 2.5 mg/ml E. coli tRNA, 0.1 mg/ml folinic acid. 7.5% PEG 8000, 200 mM potassium glutamate, 13.8 mM Mg(Ac)2, 8 µl S30 extract (x mg/ml) and about 2 µg in vitro transcribed RNA from the pool. S30 extract was prepared as described (Chen et al., 1983). Next, the sample was transferred to an ice-cold tube containing 35.2 µl 10% milk-WBT (TRIS-acetate pH 7.5, 150 mM NaCl, 50 mM Mg(Ac)2, 0.1% Tween-20, 10% milk powder) and 52.8 µl WBTH (as before plus 2.5 mg/ml heparin). Subsequently, immuno precipitation was performed by addition of 10 µg purified IgGs, incubation for 90 minutes on ice, followed by addition of 30 µl MAGmol Protein G beads (Miltenyi Biotec, 90 minutes on ice). The sample was applied to a pre-equilibrated µ column (Miltenyi Biotec) and washed 5 times with ice-cold WBT buffer. Next 20 ηl EB20 elution buffer (50 mM TRIS-acetate, 150 mM NaCl, 20 mM EDTA, 50 µg/ml S. cerevisiae RNA) was applied to the column, incubated for 5 minutes at 4° C. Elution was completed by adding 2×50 µl EB20. The mRNA from the elution sample was purified with the High pure RNA isolation kit (Roche Diagnostics). Subsequent reverse transcription was performed with Superscript II reverse transcriptase kit (Roche Diagnostics) according to the instruction of the manufacturer with 60 pmol oligo ICC202 for 1 hour at 50° C. in 50 µl volume. 5 µl of this mix was used for the following PCR reaction with primers ICC202 and ICC277 as described above.

Three rounds of ribosome display were performed and the resulting selected PCR pool subsequently cloned into plasmid pHIE11 (described above) by cleavage with restriction endonucleases NotI and FseI.

Evaluation of selected clones by sequencing and peptide-ELISA analysis: Selected clones were grown over night at 37° C. in 3 ml LB medium supplemented with 50 µg/ml Kanamycin to prepare plasmid DNA using standard procedures. Sequencing was performed at MWG (Germany) or at the Institute of Genomic Research (TIGR; Rockville, Md., U.S.A.). Peptides corresponding to the inserts were synthesized and coated in 10 mM NaHCO$_3$ pH 9.3 at a concentration of 10 µg/ml (50 µl) onto 96-well microtiter plates (Nunc). After blocking with 1% BSA in PBS at 37° C., 1:200 and 1:1000 dilutions of the indicated sera were diluted in 1% BSA/PBS and applied to the wells. After washing with PBS/0.1% Tween-20, biotin-labeled anti-human IgG secondary antibodies (SBA) were added and these were detected by subsequent adding horseradish-peroxidase-coupled streptavidin according to standard procedures.

Results

The 250-bp genomic library (L5A250/1) as described above was used for screening. Purified IgGs from uninfected adults but with high titer against S. aureus as described above were used for selection of antigenic peptides.

Three rounds of ribosome display selection and amplification were performed according to Experimental procedures; finished by cloning and sequencing the resulting PCR pool.

Sequence analyses of a large number of randomly picked clones (700) led to the identification of the gene and the corresponding peptide or protein sequence that was specifically recognized by the high titer serum used for screening. The frequency with which a specific clone was selected reflects at least in part the abundance and/or affinity of the specific antibodies in the serum used for selection and recognizing the epitope presented by this clone. Remarkably, some clones (ORFs) were picked up to 50 times, indicating their highly immunogenic property. Table 2 shows the ORF name, the Seq. ID No. and the number of times it was identified by the inventive screen.

For a number of immuno-selected ORFs peptides corresponding to, the identified immunogenic region were synthesized and tested in peptide-ELISA for their reactivity towards the sera pool they were identified with and also a number of additional sera from patients who suffered from an infection by S. aureus. The two examples in the graphs in FIG. 5 show the values of peptides from aureolysin and Pls. They are not only hyperimmune reactive against the high titer sera pool but also towards a number of individual patient's sera. All synthesized peptides corresponding to selected immunogenic regions showed reactivity towards the high titer sera pool and Table 2 summarizes the number of times the peptides were reactive towards individual patients sera, similar as described above.

In addition, it is striking that for those ORFs that were also identified by bacterial surface display described above), very often the actual immunogenic region within the ORF was identical or overlapping with the one identified by ribosome display. This comparison can be seen in Table 2.

Example 5

Identification of Highly Immunogenic Antigens from S. aureus Using Serological Proteome Analysis Experimental Procedures Surface protein preparations from S. aureus containing highly immunogenic antigens. S. aureus-strains COL (Shafer and Iandolo, 1979) and agr– (Recsei et al., 1986) were stored as glycerol stocks at –80° C. or on BHI (DIFCO) plates at 4° C. Single clones were used for inoculation of overnight cultures in either BHI ("standard conditions") or RPMI 1640 (GibcoBRL), last one depleted from iron ("stress conditions") by treating o/n with iminodiacetic acid (Sigma). Fresh medium was inoculated 1:100 the next day and bacteria were grown to O.D.$_{600}$ between 0.3 and 0.7. Bacteria were harvested by centrifugation and washed with ice-cold PBS. Surface proteins were prepared by lysostaphin treatment under isotonic conditions (Lim et al. 1998). Briefly ~3×10$^9$ bacteria (according to O.D.$_{600}$=1 are about 5×10$^7$-bacteria) were resuspended in 1 ml digestion buffer containing 35% raffinose (Aldrich Chemical Company), protease inhibitors (Roche) and 5 units lysostaphin (Sigma). After incubation at 37° C. for 30 min, protoplasts were carefully sedimented by low-speed centrifugation. This treatment releases surface proteins covalently linked to the pentaglycine bridge of the peptidoglycan cell wall to the supernatant (in Crossley, 1997). Cell surface proteins were either precipitated with methanol/chlorophorm (Wessel, 1984) or concentrated in centrifugal filter-tubes (Millipore). Protein samples were frozen and stored at –80° C. or dissolved in sample buffer and used for isoelectric focusing (IEF) immediately (Pasquali et al. 1997).

Serological proteome analysis of surface protein preparations from S. aureus. Samples were obtained from a) S. aureus/agr grown under "stress conditions", b) S. aureus/COL grown under "standard conditions" and c) S. aureus/COL "stress conditions". Loading onto 17 cm-strips containing immobilized pH gradients (pH 4-7, BioRad) was done using the "in-gel-reswelling procedure" (Pasquali et al., 1997). The gels for blotting were loaded with 100-800 µg protein, the preparative gels with 400-1,000 µg protein. Isoelectric focusing and SDS-PAGE (9-16% gradient gels) were performed as described (Pasquali et al., 1997). For Western blotting, proteins were transferred onto PVDF-membranes (BioRad) by semi-dry blotting. Transfer-efficiency was checked by amido-black staining. After blocking (PBS/0.1% Tween 20/10% dry milk, 4° C. for 16 h), blots were incubated for two hours with serum (1:2,500-1:100,000 in blocking solution, see Table 3). After washing, specific binding of serum IgG was visualized with a goat-anti-human-IgG/peroxidase conjugate (1:25,000, Southern Biotech) as secondary antibody and development with a chemiluminescence substrate (ECL™, Amersham). A representative result is shown in FIG. 6. Membranes were stripped by treatment with 2% β-ME/Laemmli buffer for 30 min at 50-65° C., immediately re-probed with a different serum, and developed as described above. This procedure was repeated up to five times. Signals showing up with patient and/or healthy donor control sera but not with the infant pool, were matched to the Coomassie (BioRad) stained preparative gels (example shown in FIG. 7). The results of these serological proteome analyses of surface protein preparations from *S. aureus* are summarized in Table 3.

Sequencing of protein spots by peptide-fingerprint MALDI-TOF-MS and tandem MS/MS. Gel pieces were washed alternately three times with 10 μl digestion buffer (10 mM NH$_4$HCO$_3$/CAN, 1:1). Afterwards the gel pieces were shrunken with 10 μl ACN and reswollen with 2 μl protease solution (0.05 μg/μl trypsin, Promega, Madison, USA). Digestion was performed for 10-12 h at 37° C. For MALDI-TOF-MS peptides were extracted from the gel pieces with 10 μl digestion buffer. The supernatant was concentrated with ZipTip™ (Millipore, Bedford, USA), the peptides were eluted onto the MALDI target with 0.5 μl extraction buffer (0.1% TFA/CAN, 1:1) and 0.5 μl matrix solution (HCCA in ACN/0.1% TFA, 1:1) was added. MALDI-TOF-MS was done using a REFLEX III (Bruker Daltonik, Bremen, Germany) equipped with a SCOUT384 ion source. The acceleration voltage was set to 25 kV, and the reflection voltage to 28.7 kV. The mass range was set from 700 Da to 4000 Da. Data acquisition was done on a SUN Ultra using XACQ software, version 4.0. Post-analysis data processing was done using XMASS software, version 4.02 (Bruker Daltonik, Bremen, Germany). The results are summarized in tables 3 and 4.

Example 6

Characterisation of Highly Immunogenic Proteins from *S. aureus*

The antigens identified by the different screening methods with the IgG and IgA preparations form pre-selected sera are further characterized, by the following ways: 1. The proteins are purified, most preferably as recombinant proteins expressed in *E. coli* or in a Gram+ expression system or in an in vitro translation system, and evaluated for antigenicity by a series of human sera. The proteins are modified based on bioinformatic analysis: N-terminal sequences representing the signal peptide are removed, C-terminal regions downstream of the cell wall anchor are also removed, and extra amino acids as tags are introduced for the ease of purification (such as Strep-tagII, His-tag, etc.) A large number of sera is then used in ELISA assays to assess the fraction of human sera containing specific antibodies against the given protein (see FIG. 9 as an example). One of the selected antigens is an 895 aa long protein, what was called LPXTGV (SEQ ID NO:640) (see Tables 2 and 4), since it contains the Gram+ cell wall anchor sequence LPXTG (SEQ ID NO:641). This signature has been shown to serve as cleavage site for sortase, a trans-peptidase which covalently links LPXTG (SEQ ID NO:641) motif containing proteins to the peptidoglycan cell wall. LPXTGV (SEQ ID NO:640) is also equipped with a typical signal peptide (FIG. 8). ELISA data using this protein as a Strep-tagged recombinant protein demonstrate that this protein is highly immunogenic (high titers relative to other recombinant proteins) in a high percentage of sera (FIG. 9). Importantly, patients with acute *S. aureus* infection produce significantly more of these anti-LPXTGV (SEQ ID NO:640) antibodies, than healthy normals, suggesting that the protein is expressed during in vivo infection. The overall ELISA titers of the individual antigenic proteins are compared, and the ones inducing the highest antibody levels (highly immunogenic) in most individuals (protein is expressed by most strains in vivo) are favored. Since the antigen specificity and quality (class, subtype, functional, nonfunctional) of the antibodies against *S. aureus* produced in individual patients can vary depending on the site of infection, accompanying chronic diseases (e.g. diabetes) and chronic conditions (e.g. intravascular device), and the individual's immune response, special attention was paid to the differences detected among the different patient groups, since medical records belonging to each sera were available. In addition, each patient serum is accompanied by the pathogenic strain isolated from the patient at the time of serum sampling.

Specific antibodies are purified for functional characterization. The purity and the integrity of the recombinant proteins are checked (e.g. detecting the N-terminal Strep-tag in Western blot analysis in comparison to silver staining in SDS-PAGE). The antigens are immobilized through the tags to create an affinity matrix, and used for the purification of specific antibodies from highly reactive sera. Using as an example strep-tagged LPXTGV (SEQ ID NO:640) as the capture antigen, 20 μg of antibody from 125 mg of IgG were purified. Based on the ELISA data a pure preparation was received, not having e.g. anti-LTA and anti-peptidoglycan (both dominant with unfractionated IgG) activity. The antibodies are then used to test cell surface localization by FACS and fluorescent microscopy (FIG. 10).

3. Gene Occurrence in Clinical Isolates

An ideal vaccine antigen would be an antigen that is present in all, or the vast majority of, strains of the target organism to which the vaccine is directed. In order to establish whether the genes encoding the identified *Staphylococcus aureus* antigens occur ubiquitously in *S. aureus* strains, PCR was performed on a series of independent *S. aureus* isolates with primers specific for the gene of interest. *S. aureus* isolates were obtained from patients with various *S. aureus* infections. In addition several nasal isolates from healthy carriers and several lab strains were also collected and analyzed. The strains were typed according to restriction fragment length polymorphism (RFLP) of the spa and coa genes (Goh et al. 1992, Frénay et al., 1994, vanden Bergh et al. 1999). From these results 30 different strains were identified—24 patient isolates, 3 nasal isolates and 3 lab strains. To establish the gene distribution of selected antigens, the genomic DNA of these 30 strains was subjected to PCR with gene specific primers that flank the selected epitope (ORF1361: Seq. ID No. 187 and 188; ORF2268: Seq. ID No. 193 and 194; ORF1951: Seq. ID No. 195 and 196; ORF1632: Seq. ID No. 181 and 182; ORF0766: Seq. ID No. 183 and 184; ORF0576: Seq. ID No. 185 and 186; ORF0222: Seq. ID No. 189 and 190; ORF0360: Seq. ID No. 191 and 192). The PCR products were analyzed by gel electrophoresis to identify a product of the correct predicted size. ORFs 1361, 2268, 1951, 1632, 0766 and 0222 are present in 100% of strains tested and ORF0576 in 97%. However ORF0360 occurred in only 71% of the strains. Thus ORFs 1361, 2268, 1951, 1632, 0766, 0576 and 0222 each have the required ubiquitous presence among *S. aureus* isolates.

These antigens (or antigenic fragments thereof, especially the fragments identified) are especially preferred for use in a vaccination project against *S. aureus*.

4. Identification of Highly Promiscuous HLA-class II Helper Epitopes Within the ORFs of Selected Antigens The ORFs corresponding to the antigens identified on the basis of recognition by antibodies in human sera, most likely also contain linear T-cell epitopes. Especially the surprising finding in the course of the invention that even healthy uninfected, non-colonized individuals show extremely high antibody titers (>100,000 for some antigens, see Example 5) which are stable for >1 year (see Example 1), suggests the existence of T-cell dependent memory most probably mediated by CD4+ helper-T-cells. The molecular definition of the corresponding HLA class II helper-epitopes is useful for the design of synthetic anti-staphylococcal vaccines, which can induce immunological memory. In this scenario the helper-epitopes derived from the staphylococcal antigens provide "cognate help" to the B-cell response against these antigens or fragments thereof. Moreover it is possible to use these helper-epitopes to induce memory to T-independent antigens like for instance carbohydrates (conjugate vaccines). On the other hand, intracellular occurring staphylococci can be eliminated by CD8+ cytotoxic T-cells, which recognize HLA class I restricted epitopes.

T-cell epitopes can be predicted by various public domain algorithms: http://bimas.dcrt.nih.gov/molbio/hla_bind/ (Parker et al. 1994), http://134.2.96.221/scripts/MHCServer.dll/home.htm (Rammensee at al. 1999), http://mypage.ihost.com/usinet.hamme76/ (Sturniolo et al. 1999). The latter prediction algorithm offers the possibility to identify promiscuous helper-epitopes, i.e. peptides that bind to several HLA class II molecules. In order to identify highly promiscuous helper-epitopes within staphylococcal antigens the ORFs corresponding to Seq ID 64 (IsaA), Seq ID 114 (POV2), Seq ID 89 (ORF0222), Seq ID 70 (LPXTGIV), Seq ID 56 (LPXTGV), Seq ID 142 (LPXTGVI), Seq ID 81 (ORF3200), Seq ID 74 (ORF1951), Seq ID 94 (Empbp), Seq ID 83 (autolysin) and Seq ID 58 (ORF2498) were analyzed using the TEPITOPE package http://mypage.ihost.com/usinet.hamme76/ (Sturniolo et al. 1999). The analysis was done for 25 prevalent DR-alleles and peptides were selected if they were predicted to be a) strong binders (1% threshold) for at least 10/25 alleles or b) intermediate (3% threshold) binders for at least 17/25 alleles.

The following peptides containing one or several promiscuous helper-epitopes were selected (and are claimed):

| Seq ID 56: | pos. 6-40, 583-598, 620-646, 871-896 |
| Seq ID 58: | no peptide fulfills selection criteria |
| Seq ID 64: | no peptide fulfills selection criteria |
| Seq ID 70: | pos. 24-53 |
| Seq ID 74: | pos. 240-260 |
| Seq ID 81: | pos. 1660-1682, 1746-1790 |
| Seq ID 83: | pos. 1-29, 680-709, 878-902 |
| Seq ID 89: | pos. 96-136 |
| Seq ID 94: | pos. 1-29, 226-269, 275-326 |
| Seq ID 114: | pos. 23-47, 107-156 |
| Seq ID 142: | pos. 24-53 |

The corresponding peptides or fragments thereof (for instance overlapping 15-mers) can be synthesized and tested for their ability to bind to various HLA molecules in vitro. Their immunogenicity can be tested by assessing the peptide (antigen)-driven proliferation (BrdU or 3H-thymidine incorporation) or the secretion of cytokines (ELIspot, intracellular cytokine staining) of T-cells in vitro (Mayer et al. 1996, Schmittel et al. 2000, Sester et al. 2000). In this regard it will be interesting to determine quantitative and qualitative differences in the T-cell response to the staphylococcal antigens or the selected promiscuous peptides or fragments thereof in populations of patients with different staphylococcal infections, or colonization versus healthy individuals neither recently infected nor colonized. Moreover, a correlation between the antibody titers and the quantity and quality of the T-cell response observed in these populations is expected. Alternatively, immunogenicity of the predicted peptides can be tested in HLA-transgenic mice (Sonderstrup et al. 1999).

Similar approaches can be taken for the identification of HLA class I restricted epitopes within staphylococcal antigens.

Synthetic Peptides Representing One or More Promiscuous T Helper Epitopes from *S. aureus*

Partially overlapping peptides spanning the indicated regions of Seq ID 56 (LPXTGV), Seq ID 70 (LPXTGIV), Seq ID 74 (ORF1hom1), Seq ID 81 (EM_BP), Seq ID 83 (Autolysin), Seq ID 89 (ORF1hom2), Seq ID 94 (EMPBP), Seq ID 114 (POV2) and Seq ID 142 (LPXTGVI) were synthesized. Sequences of the individual peptides are given in Table 5. All peptides were synthesized using Fmoc chemistry, HPLC purified and analyzed by mass spectrometry. Lyophilized peptides were dissolved in DMSO and stored at −20° C. at a concentration of 5-10 mM.

Binding of Synthetic Peptides Representing Promiscuous T Helper Epitopes to HLA Molecules In Vitro Binding of peptides to HLA molecules on the surface of antigen-presenting cells is a prerequisite for activation of T cells. Binding was assessed in vitro by two independent biochemical assays using recombinant soluble versions of HLA class II molecules. One assay measures the concentration dependent competitive replacement of a labeled reference peptide by the test peptides. The second assay is based on the formation of SDS-stable complexes upon binding of high- and intermediate affinity ligands. A summary of the results obtained by the two assays is given in Table 5.

Soluble HLA molecules (DRA1*0101/DRB1*0101 and DRA1*0101/DRB1*0401) were expressed in SC-2 cells and purified as described in Aichinger et al., 1997. For the competition assay (Hammer et al. 1995) HLA molecules were applied between 50 and 200 ng/well. For DRB1*0101 biotinilated indicator peptide HA (PKYVKQNTLKLAT—SEQ ID NO:602, Valli et al. 1993) was used at 0.008 µM. For DRB1*0401 biotinilated indicator peptide UD4 (YPKFVKQNTLKAA—SEQ ID NO:603, Valli et al. 1993) was used between 0.03 and 0.06 µM. Molecules, indicator and test peptides were incubated overnight at 37° C., pH 7. HLA: peptide complexes obtained after incubation with serial dilutions of test and reference peptides (the known high-affinity binders HA and UD4 were used as positive control) were captured in ELISA plates coated with antibody L243, which is known to recognize a conformational epitope formed only by correctly associated heterodimers. Incorporated biotin was measured by standard colorimetric detection using a streptavidin-alkaline phosphatase conjugate (Dako) with NBT/BCIP tablets (Sigma) as substrate and automated OD reading on a Victor reader (Wallac).

T Cell Response Against Promiscuous T Helper Epitopes Assessed by IFNg ELIspot Assay Upon antigenic stimulation T cells start to proliferate and to secrete cytokines such as interferon gamma (IFNg). Human T cells specifically recognizing epitopes within *S. aureus* antigens were detected by IFNg-ELIspot (Schmittel et al. 2000). PBMCs from healthy individuals with a strong anti-*S. aureus* IgG response were isolated from 50-100 ml of venous blood by ficoll density gradient centrifugation and used after freezing and thawing. Cells were seeded at 200,000/well in 96-well plates. Peptides were added as mixtures corresponding to individual antigens, in both cases at 10 µg/ml each. Concanavalin A (Amersham) and PPD (tuberculin purified protein derivate, Statens Serum Institute) served as assay positive controls, assay medium without any peptide as negative control. After overnight incubation in Multi Screen 96-well filtration plates (Millipore) coated with the anti-human IFNg monoclonal antibody B140 (Bender Med Systems) the ELIspot was developed using the biotinylated anti-human IFNg monoclonal antibody B308-BT2 (Bender Med Systems), Streptavidin-alkaline phosphatase (DAKO) and BCIP/NBT alkaline phosphatase substrate (SIGMA). Spots were counted using an automatic plate reader (Bio-reader 2000, BIO-SYS). Spots counted in wells with cells stimulated with assay medium only (negative control, generally below 10 spots/100.000 cells) were regarded as background and subtracted from spot numbers counted in wells with peptides.

TABLE 5

Promiscuous T helper epitopes contained in *S. aureus* antigens

| Amino acid sequences within *S. aureus* antigens containing highly promiscuous T helper epitopes | binding[1] | IFNg ELIspot[2] |
|---|---|---|
| Seq ID 56 (LPXTGV): pos. 6-40 | | |
| p6-28    >PKLRSFYSIRKSTLGVASVIVST// | + | |
| p24-40            >VIVSTLFLISQHQAQA// | − | 44; 80; 8; 95; 112 |
| Seq ID 56 (LPXTGV): pos. 620-646 | | |
| p620-646  >FPYIPDKAVYNAIVKVVVANIGYEGQ// | + | |
| Seq ID 56 (LPXTGV): pos. 871-896 | | |
| p871-896  >QSWWGLYALLGMLALFIPKFRKESK// | − | |
| Seq ID 70 (LPXTGIV): pos. 24-53 | | |
| p24-53    >YSIRKFTVGTASILIGSLMYLGTQQEAEA// | nd | 34; 14; 0; 57; 16 |
| Seq ID 74 (ORF1hom1): pos. 240-260 | | |
| p240-260   >MNYGYGPGVVTSRTISASQA// | + | 47; 50; 0; 85; 92 |
| Seq ID 81 (EM_BP): pos. 1660-1682 | | |
| p1660-1682 >NEIVLETIRDINNAHTLQQVEA// | nd | 2; 14; 5; 77; 26 |
| Seq ID 81 (EM_BP): pos. 1746-1790 | | |
| p1746-1773 >LHMRHFSNNFGNVIKNAIGVVGISGLLA// | nd | |
| p1753-1779       >NNFGNVIKNAIGVVGISGLLASFWFFI// | nd | |
| p1777-1789                        >FFIAKRRRKEDEE/ | nd | |
| Seq ID 83 (Autolysin) pos. 1-29 | | |
| p1-29:     >MAKKFNYKLPSMVALTLVGSAVTAHQVQA// | nd | 6; 35; 7; 60; 49 |
| Seq ID 83 (Autolysin) pos. 878-902 | | |
| p878-902:  >NGLSMVPWGTKNQVILTGNNIAQG/ | nd | |
| Seq ID 89 (ORF1hom2): pos. 96-136 | | |
| p96-121    >GESLNIIASRYQVSVDQLMAANNLRG// | − | 0; 35; 0; 29; 104 |
| p117-136                    >NNLRGYLIMPNQTLQIPNG// | − | |
| Seq ID 94 (EMPBP): pos. 1-29 | | |
| p4-29:     >KLLVLTMSTLFATQIMNSNHAKASV// | + | |
| Seq ID 94 (EMPBP): pos. 226-269 | | |
| p226-251   >IKINHFCVVPQINSFKVIPPYGHNS// | − | 26; 28; 16; 43; 97 |
| p254-270       >MHVPSFQNNTTATHQN// | + | |
| Seq ID 94 (EMPBP): pos. 275-326 | | |
| p275-299   >YDYKYFYSYKVVKGVKKYFSFSQS// | + | |
| p284-305           >YKVVKGVKKYFSFSQSNGYKIG// | + | |
| p306-326   >PSLNIKNVNYQYAVPSYSPT// | + | |
| Seq ID 114 (POV2): pos. 23-47 | | |
| p23-47     >AGGIFYNQTNQQLLVLCDGMGGHK// | − | 49; 20; 4; 77; 25 |
| Seq ID 114 (POV2): pos. 107-156 | | |
| p107-124   >ALVFEKSVVIANVGDSRA/ | − | |
| p126-146   >RAYVINSRQIEQITSDHSFVN// | nd | |
| p142-158              >SFVNHLVLTGQITPEE// | nd | |

TABLE 5-continued

Promiscuous T helper epitopes contained in S. aureus antigens

| Amino acid sequences within S. aureus antigens containing highly promiscuous T helper epitopes | binding[1] | IFNg ELIspot[2] |
|---|---|---|
| Seq ID 142 (LPXTGVI): pos. 1-42 | | |
| p6-30    >KEFKSFYSIRKSSLGVASVAISTL// | ++ | 0; 41; 20; |
| p18-42         >SSLGVASVAISTLLLLMSNGEAQA// | nd | 88; 109 |
| | | |
| Seq ID 142 (LPXTGVI): pos. 209-244 | | |
| p209-233  >IKLVSYDTVKDYAYIRFSVSNGTKA// | + | |
| p218-244         >KDYAYIRFSVSNGTKAVKIVSSTHFNN// | + | |
| | | |
| Seq ID 142 (LPXTGVI): pos. 395-428 | | |
| p395-418  >FMVEGQRVRTISTYAINNTRCTIF// | − | |
| p416-428              >TIFRYVEGSLYE// | − | |
| | | |
| Seq ID 142 (LPXTGVI): pos. 623-647 | | |
| p623-647  >MTLPLMALLALSSIVAFVLPRKRKN// | − | |

[1] binding to soluble DRA1*0101/DRB1*0401 molecules was determined using a competition assay (+, ++: binding, −: no competition up to 200 μM test peptide; nd: not done)
[2] results from 5 healthy individuals with strong anti-S. aureus IgG response. Data are represented as spots/200.000 cells (background values are subtracted 5. Antigens may be Injected into Mice—and the Antibodies Against these Proteins can be Measured.

6. Protective Capacity of the Antibodies Induced by the Antigens Through Vaccination can be Assessed in Animal Models.

Both 5. and 6. are methods well available to the skilled man in the art.

Example 7

Applications

A) An effective vaccine offers great potential for patients facing elective surgery in general, and those receiving endovascular devices, in particular. Patients suffering from chronic diseases with decreased immune responses or undergoing continuous ambulatory peritoneal dialysis are likely to benefit from a vaccine with S. aureus by immunogenic serum-reactive antigens according to the present invention. Identification of the relevant antigens will help to generate effective passive immunization (humanized monoclonal antibody therapy), which can replace human immunoglobulin administration with all its dangerous side-effects. Therefore an effective vaccine offers great potential for patients facing elective surgery in general, and those receiving endovascular devices, in particular.

S. aureus can cause many different diseases.
1. Sepsis, bacteriaemia
2. Haemodialysed patients—bacteriemia, sepsis
3. Peritoneal dialyses patients—peritonitis
4. Patients with endovascular devices (heart surgery, etc)—endocarditis, bacteriemia, sepsis
5. Orthopedic patients with prosthetic devices septic arthritis
6. Preventive vaccination of general population B) Passive and active vaccination, both with special attention to T-cells with the latter one: It is an aim to induce a strong T helper response during vaccination to achieve efficient humoral response and also immunological memory. Up till now, there is no direct evidence that T-cells play an important role in clearing S. aureus infections, however, it was not adequately addressed, so far. An effective humoral response against proteinaceous antigens must involve T help, and is essential for developing memory. Naïve CD4+ cells can differentiated into Th1 or Th2 cells. Since, innate immunological responses (cytokines) will influence this decision, the involvement of T-cells might be different during an acute, serious infection relative to immunization of healthy individuals with subunit vaccines, not containing components which impair the immune response during the natural course of the infection. The consequences of inducing Th1 or Th2 responses are profound. Th1 cells lead to cell-mediated immunity, whereas Th2 cells provide humoral immunity.

C) Preventive and Therapeutic Vaccines

Preventive: active vaccination/passive immunization of people in high risk groups, before infection Therapeutic: passive vaccination of the already sick.

Active Vaccination to Remove Nasal Carriage

Specific Example for an Application

Elimination of MRSA Carriage and Prevention of Colonization of the Medical Staff Carriage rates of S. aureus in the nares of people outside of the hospitals varies from 10 to 40%. Hospital patients and personnel have higher carriage rates. The rates are especially high in patients undergoing hemodialysis and in diabetics, drug addicts and patients with a variety of dermatologic conditions. Patients at highest risk for MRSA infection are those in large tertiary-care hospitals, particularly the elderly and immunocompromised, those in intensive care units, burn patients, those with surgical wounds, and patients with intravenous catheters.

The ELISA data strongly suggest that there is a pronounced IgA response to S. aureus, which is not obvious or known from the literature. Since the predominant mucosal immune response is the production of IgA with neutralizing activity, it is clear that the staphylococcal epitopes and antigens identified with the highly pure IgA preparations lead to an efficient mucosal vaccine.

Clear indication: Everybody's threat in the departments where they perform operation (esp. orthopedics, traumatology, gen. surgery)

Well-defined population for vaccination (doctors and nurses)

Health care workers identified as intranasal carriers of an epidemic strain of S. aureus are currently treated with mupirocin and rifampicin until they eliminate the bacteria. Sometimes it is not effective, and takes time.

Available animal model: There are mice models for intranasal carriage.

TABLE 1

ELISA titers of sera from non-infected individuals against multiple *staphylococcal* proteins.

| Sera ID# | BHI lysate | LTA | PG | ClfA | D1 + D3 | FnBPA | sdrE | sdrC | EBP |
|---|---|---|---|---|---|---|---|---|---|
| 1 | | | | | | | | | |
| 2 | 2... | 2... | | 8... | 4... | | | | |
| 3 | 7... | | | 3... | | | 1... | 1... | |
| 4 | 1****** | 1****** | 1... | 6... | 2... | 2... | 3... | 6... | 2... |
| 5 | | | | | | | | | |
| 6 | | | | | | | | 4... | |
| 7 | | 6... | | | | | 7... | | 7... |
| 8 | | | | | | | 8... | | 8... |
| 9 | 4, 5, 6... | 4... | 5... | 5... | | | 6... | 3... | 1... |
| 10 | | | | | | | | | |
| 11 | | | | 6... | | | | | |
| 12 | | | | | | | | | |
| 13 | | | | | | | 5... | 2... | |
| 14 | | | | | | | | | |
| 15 | 3... | 5... | 2, 3... | | | 5... | | | |
| 16 | | | | | | | | | |
| 17 | | | | | | | | | |
| 18 | | | 6, 7... | 1... | | | | | 3... |
| 19 | | | | | | | | | |
| 20 | | | | | | | | | |
| 21 | | | | 2... | | | | | |
| 22 | | | | | | | | | |
| 23 | 4, 5, 6... | | | 5... | 3... | 6... | 2... | 7... | 4... |
| 24 | | | | | | | 4... | | 6... |
| 25 | | | 5... | | | | | | |
| 26 | 8... | | | | | | | | |
| 27 | | | | | | | | 8... | |
| 28 | | | | | | | | | |
| 29 | | | | | | | | | |
| 30 | | | | | | | | | |
| 31 | | | | | 1... | 1... | | | |
| 32 | | | 4... | | | | | | |
| 33 | | | 8... | 4... | | 4... | | 5... | |
| 34 | | | | 7, 8... | | | | | |
| 35 | 4, 5, 6... | 8... | 2, 3... | | | | | | 5... |
| 36 | | 3... | | | | | | | |
| 37 | | | | 7... | 7, 8... | | | | |
| 38 | | | | 8... | | | | | |
| 39 | | | | | | | | | |
| 40 | | 7... | 6, 7... | | | 3... | | | |

| Sera ID# | enolase | LP309 | LP342 | coagul | Fib | SrtA | ClfB | Map-w |
|---|---|---|---|---|---|---|---|---|
| 1 | | | | | | | | |
| 2 | | | | 6... | | 3... | | |
| 3 | | 3... | 2... | 2... | 2... | 3... | 7... | 4... |
| 4 | 6, 7... | 8... | 3... | | | 4... | 1... | 3... |
| 5 | | | | | | | | |
| 6 | | 5... | | | | | | |
| 7 | 5... | | | | 4... | | | 7... |
| 8 | | | | | 5... | 7... | 8, 9... | |
| 9 | 3, 4... | | | | 1... | | 5, 6... | |
| 10 | | | | | | | 5, 6... | |
| 11 | | | | | 6... | | | |
| 12 | | | | 4, 5... | | | | |
| 13 | | | | | 8... | | | |
| 14 | | | | | | | | |
| 15 | | 6... | 7... | | | 8... | | 8, 9... |
| 16 | | | | | | | | 6... |
| 17 | | | | | | | | |
| 18 | | | | | | | 4... | |
| 19 | | | | | | | | 1... |
| 20 | | | | | | | | |
| 21 | | | | | | | | 2... |
| 22 | | | | | | | | |
| 23 | 6, 7... | 7... | | 6, 7... | | 2... | 2... | |
| 24 | | | | | | | | 8, 9... |
| 25 | | | | | | | | |
| 26 | | | | | 7... | | | |
| 27 | | 4... | 4, 5... | 4, 5... | | 5... | | |
| 28 | | | | | | | | |

TABLE 1-continued

ELISA titers of sera from non-infected individuals against multiple staphylococcal proteins.

| | | | | | | | | |
|---|---|---|---|---|---|---|---|---|
| 29 | 1... | | | | | | | |
| 30 | | | | | | | | |
| 31 | | | | 1... | | | | |
| 32 | | | | | | | | |
| 33 | | | | | | | | |
| 34 | 2... | 2... | 1... | 6, 7... | 6... | 1... | | |
| 35 | | 1****** | | | | | 3... | 4... |
| 36 | | | | | | | | |
| 37 | | | | 3... | | | | |
| 38 | 3, 4... | | | | | | | |
| 39 | | | | | | | | |
| 40 | | | 4, 5... | | | | 8, 9... | |

Anti-staphylococcal antibody levels were measured individually by standard ELISA with total lysate prepared from S. aureus grown in BHI medium (BHI), lipoteichoic acid (LTA), peptidoglycan (PG), 13 recombinant proteins, representing cell surface and secreted proteins, such as clumping factor A and B (ClfA, ClfB), Fibronectin-binding protein (FnBPA), SD-repeat proteins (sdrC, sdrE), MHC Class II analogous protein (map-w), Elastin-binding protein (EBP), enolase (reported to be cell surface located and immunogenic), iron transport lipoproteins (LP309, LP342), sortase (srtA), coagulase (coa), extracellular fibrinogen-binding protein (fib). Two short synthetic peptides representing 2 of the five immunodominant D repeat domains from FnBPA was also included (D1 + D3) as antigens. The individual sera were ranked based on the IgG titer, and obtained a score from 1-9. Score 1 labels the highest titer serum and score 8 or 9 labels the sera which were $8^{th}$ or $9^{th}$ among all the sera tested for the given antigen. It resulted in the analyses of the top 20 percentile of sera (8-9/40). The five "best sera" meaning the most hyper reactive in terms of anti-staphylococcal antibodies were selected based on the number of scores 1-8.
******means that the antibody reactivity against the particular antigen was exceptionally high (>2x ELISA units relative to the $2^{nd}$ most reactive serum).

TABLE 2a

Immunogenic proteins identified by bacterial surface and ribosome display: s. aureus

| S. aureus antigenic protein | Old ORF number | Putative function (by homology) | predicted immunogenic aa** |
|---|---|---|---|
| SaA0003 | ORF2963P | repC | 5-20, 37-44, 52-59, 87-94, 116-132 |
| SaA0003 | ORF2967P | repC | 7-19, 46-57, 85-91, 110-117, 125-133, 140-149, 156-163, 198-204, 236-251, 269-275, 283-290, 318-323, 347-363 |
| 0093 | ORF1879 | SdrC | 23-51, 75-80, 90-99, 101-107, 151-157, 173-180, 186-205, 215-226, 239-263, 269-274, 284-304, 317-323, 329-336, 340-347, 360-366, 372-379, 391-397, 399-406, 413-425, 430-436, 444-455, 499-505, 520-529, 553-568, 586-592, 600-617, 631-639, 664-678, 695-701, 891-903, 906-912, 926-940 |
| 0095 | ORF1881 | SdrE | 25-45, 72-77, 147-155, 198-211, 217-223, 232-238, 246-261, 266-278, 281-294, 299-304, 332-340, 353-360, 367-380, 384-396, 404-409, 418-429, 434-440, 448-460, 465-476, 493-509, 517-523, 531-540, 543-555, 561-566, 576-582, 584-591, 603-617, 633-643, 647-652, 668-674, 677-683, 696-704, 716-728, 744-752, 755-761, 789-796, 809-815, 826-840, 854-862, 887-903, 918-924, 1110-1116, 1125-1131, 1145-1159 |
| 0123 | ORF1909 | unknown | 9-28, 43-48, 56-75, 109-126, 128-141, 143-162, 164-195, 197-216, 234-242, 244-251 |
| 0160 | ORF1941 | unknown | 4-10, 20-42, 50-86, 88-98, 102-171, 176-182, 189-221, 223-244, 246-268, 276-284, 296-329 |
| 0222 | ORF1988 | homology with ORF1 | 4-9, 13-24, 26-34, 37-43, 45-51, 59-73, 90-96, 99-113, 160-173, 178-184, 218-228, 233-238, 255-262 |
| 0308 | ORF2077 | Complement, unknown | 13-27, 42-63, 107-191, 198-215, 218-225, 233-250 |
| 0317 | ORF2088 | preprotein translocase seca subunit | 16-29, 64-77, 87-93, 95-101, 127-143, 150-161, 204-221, 225-230, 236-249, 263-269, 281-309, 311-325, 337-343, 411-418, 421-432, 435-448, 461-467, 474-480, 483-489, |

TABLE 2a-continued

Immunogenic proteins identified by bacterial surface and ribosome display: s. aureus

| | | | |
|---|---|---|---|
| | | | 508-516, 542-550, 580-589, 602-611, 630-636, 658-672, 688-705, 717-723, 738-746, 775-786, 800-805, 812-821, 828-834 |
| 0337 | ORF2110 | Hypothetical protein | 26-53, 95-123, 164-176, 189-199 |
| 0358 | ORF2132 | Clumping factor A | 8-35, 41-48, 59-66, 87-93, 139-144, 156-163, 198-209, 215-229, 236-244, 246-273, 276-283, 285-326, 328-342, 349-355, 362-370, 372-384, 396-402, 405-415, 423-428, 432-452, 458-465, 471-477, 484-494, 502-515, 540-547, 554-559, 869-875, 893-898, 907-924 |
| 0360 | ORF2135 Empbp | extracellular matrix and plasma binding protein | 7-13, 15-23, 26-33, 68-81, 84-90, 106-117, 129-137, 140-159, 165-172, 177-230, 234-240, 258-278, 295-319 |
| 0453 | ORF2227 | coma operon protein 2 | 17-25, 27-55, 84-90, 95-101, 115-121 |
| 0569 | ORF1640 | V8 protease | 5-32, 66-72, 87-98, 104-112, 116-124, 128-137, 162-168, 174-183, 248-254, 261-266, 289-303, 312-331 |
| 0576 | ORF1633 Autolysin | autolysin, adhesion | 4-19, 57-70, 79-88, 126-132, 144-159, 161-167, 180-198, 200-212, 233-240, 248-255, 276-286, 298-304, 309-323, 332-346, 357-366, 374-391, 394-406, 450-456, 466-473, 479-487, 498-505, 507-519, 521-530, 532-540, 555-565, 571-581, 600-611, 619-625, 634-642, 650-656, 658-665, 676-682, 690-699, 724-733, 740-771, 774-784, 791-797, 808-815, 821-828, 832-838, 876-881, 893-906, 922-929, 938-943, 948-953, 969-976, 1002-1008, 1015-1035, 1056-1069, 1105-1116, 1124-1135, 1144-1151, 1173-1181, 1186-1191, 1206-1215, 1225-1230, 1235-1242 |
| 0657 | ORF unknown | LPXTGVI protein | 9-33, 56-62, 75-84, 99-105, 122-127, 163-180, 186-192, 206-228, 233-240, 254-262, 275-283, 289-296, 322-330, 348-355, 416-424, 426-438, 441-452, 484-491, 541-549, 563-569, 578-584, 624-641 |
| 0749 | ORF1462 | Carbamoyl-phosphate synthase | 8-23, 31-38, 42-49, 61-77, 83-90, 99-108, 110-119, 140-147, 149-155, 159-171, 180-185, 189-209, 228-234, 245-262, 264-275, 280-302, 304-330, 343-360, 391-409, 432-437, 454-463, 467-474, 478-485, 515-528, 532-539, 553-567, 569-581, 586-592, 605-612, 627-635, 639-656, 671-682, 700-714, 731-747, 754-770, 775-791, 797-834, 838-848, 872-891, 927-933, 935-942, 948-968, 976-986, 1000-1007, 1029-1037 |
| 944 | ORF1414 | Yfix | 6-33, 40-46, 51-59, 61-77, 84-104, 112-118, 124-187, 194-248, 252-296, 308-325, 327-361, 367-393, 396-437, 452-479, 484-520, 535-545, 558-574, 582-614, 627-633, 656-663, 671-678, 698-704, 713-722, 725-742, 744-755, 770-784, 786-800, 816-822, 827-837 |
| 1050 | ORF1307 | unknown | 49-72, 76-83, 95-105, 135-146, 148-164, 183-205 |
| 1209 | ORF3006 | hemN homolog | 12-36, 43-50, 58-65, 73-78, 80-87, 108-139, 147-153, 159-172, 190-203, 211-216, 224-232, 234-246, 256-261, 273-279, 286-293, 299-306, 340-346, 354-366 |
| 1344 | ORF0212 | NifS protein homolog | 8-16, 22-35, 49-58, 70-77, 101-121, 123-132, 147-161, 163-192, 203-209, 216-234, 238-249, 268-274, |

TABLE 2a-continued

Immunogenic proteins identified by bacterial surface and ribosome display: *s. aureus*

| | | | |
|---|---|---|---|
| | | | 280-293, 298-318, 328-333, 339-345, 355-361, 372-381 |
| 1356 | ORF0197 | Hypothetical protease | 28-55, 82-100, 105-111, 125-131, 137-143 |
| 1361 | ORF0190 | LPXTGV protein | 5-39, 111-117, 125-132, 134-141, 167-191, 196-202, 214-232, 236-241, 244-249, 292-297, 319-328, 336-341, 365-380, 385-391, 407-416, 420-429, 435-441, 452-461, 477-488, 491-498, 518-532, 545-556, 569-576, 581-587, 595-602, 604-609, 617-640, 643-651, 702-715, 723-731, 786-793, 805-811, 826-839, 874-889 |
| 1371 | ORF0175 | YtpT, conserved hypothetical protein | 37-42, 57-62, 121-135, 139-145, 183-190, 204-212, 220-227, 242-248, 278-288, 295-30, 304-309, 335-341, 396-404, 412-433, 443-449, 497-503, 505-513, 539-545, 552-558, 601-617, 629-649, 702-711, 736-745, 793-804, 814-829, 843-858, 864-885, 889-895, 905-913, 919-929, 937-943, 957-965, 970-986, 990-1030, 1038-1049, 1063-1072, 1080-1091, 1093-1116, 1126-1136, 1145-1157, 1163-1171, 1177-1183, 1189-1196, 1211-1218, 1225-1235, 1242-1256, 1261-1269 |
| 1491 | ORF0053 | Cmp binding factor 1 homolog | 12-29, 34-40, 63-71, 101-110, 114-122, 130-138, 140-195, 197-209, 215-229, 239-253, 255-274 |
| 1616 | ORF1180 | leukocidin F homolog | 16-24, 32-39, 43-49, 64-71, 93-99, 126-141, 144-156, 210-218, 226-233, 265-273, 276-284 |
| 1618 | ORF1178 | LukM homolog | 5-24, 88-94, 102-113, 132-143, 163-173, 216-224, 254-269, 273-278, 305-313, 321-327, 334-341 |
| 1632 | ORF1163 | SdrH homolog | 7-35, 54-59, 247-261, 263-272, 302-320, 330-339, 368-374, 382-411 |
| 1763 | ORF1024 | unknown | 5-32, 35-48, 55-76 |
| 1845 | ORF0942 | Hyaluronate lyase | 10-26, 31-44, 60-66, 99-104, 146-153, 163-169, 197-205, 216-223, 226-238, 241-258, 271-280, 295-315, 346-351, 371-385, 396-407, 440-446, 452-457, 460-466, 492-510, 537-543, 546-551, 565-582, 590-595, 635-650, 672-678, 686-701, 705-712, 714-721, 725-731, 762-768, 800-805 |
| 1951 | ORF0831 | homology with ORF1 | 5-22, 42-50, 74-81, 139-145, 167-178, 220-230, 246-253, 255-264 |
| 1955 | ORF0826 | homology with ORF1 | 4-9, 15-26, 65-76, 108-115, 119-128, 144-153 |
| 2031 | ORF0749 | unknown | 10-26, 31-43, 46-58, 61-66, 69-79, 85-92, 100-115, 120-126, 128-135, 149-155, 167-173, 178-187, 189-196, 202-222, 225-231, 233-240, 245-251, 257-263, 271-292, 314-322, 325-334, 339-345 |
| 2086 | ORF0691 Sbi | IgG binding protein | 6-20, 53-63, 83-90, 135-146, 195-208, 244-259, 263-314, 319-327, 337-349, 353-362, 365-374, 380-390, 397-405, 407-415 |
| 2180 | ORF0594 | LPXTGIV protein | 11-20, 26-47, 69-75, 84-92, 102-109, 119-136, 139-147, 160-170, 178-185, 190-196, 208-215, 225-233, 245-250, 265-272, 277-284, 300-306, 346-357, 373-379, 384-390, 429-435, 471-481, 502-507, 536-561, 663-688, 791-816, 905-910, 919-933, 977-985, 1001-1010, 1052-1057, 1070-1077, 1082-1087, 1094-1112 |
| 2184 | ORF0590 | FnbpB | 5-12, 18-37, 104-124, 139-145, 154-166, 175-181, 185-190, 193-199, 203-209, 235-244, 268-274, |

TABLE 2a-continued

Immunogenic proteins identified by bacterial surface
and ribosome display: *s. aureus*

| | | | |
|---|---|---|---|
| | | | 278-292, 299-307, 309-320, 356-364, 375-384, 390-404, 430-440, 450-461, 488-495, 505-511, 527-535, 551-556, 567-573, 587-593, 599-609, 624-631, 651-656, 665-671, 714-726, 754-766, 799-804, 818-825, 827-833, 841-847, 855-861, 876-893, 895-903, 927-940 |
| 2186 | ORF0588 | Fnbp | 8-29, 96-105, 114-121, 123-129, 141-147, 151-165, 171-183, 198-206, 222-232, 253-265, 267-277, 294-300, 302-312, 332-338, 362-368, 377-383, 396-402, 410-416, 451-459, 473-489, 497-503, 537-543, 549-559, 581-600, 623-629, 643-649, 655-666, 680-687, 694-700, 707-712, 721-727, 770-782, 810-822, 874-881, 883-889, 897-903, 911-917, 925-931, 933-939, 946-963, 965-973, 997-1010 |
| 2224 | ORF0551 | unknown | 49-56, 62-68, 83-89, 92-98, 109-115, 124-131, 142-159, 161-167, 169-175, 177-188, 196-224, 230-243, 246-252 |
| 2254 | ORF0519 | Conserved hypothetical protein | 14-22, 32-40, 52-58, 61-77, 81-93, 111-117, 124-138, 151-190, 193-214, 224-244, 253-277, 287-295, 307-324, 326-332, 348-355, 357-362, 384-394, 397-434, 437-460, 489-496, 503-510, 516-522, 528-539, 541-547, 552-558, 563-573, 589-595, 602-624, 626-632, 651-667, 673-689, 694-706, 712-739, 756-790 |
| 2264 | ORF0509 | ORF1; homology with putative secreted antigen precursor from *S. epidermidis* | 5-31, 47-55, 99-104, 133-139, 156-172, 214-224, 240-247 |
| 2268 | ORF0503 | IsaA, possibly adhesion/aggregation | 7-19, 26-45, 60-68, 94-100, 111-119, 126-137, 143-148, 169-181, 217-228 |
| 2344 | ORF0426 | Clumping factor B | 4-10, 17-45, 120-127, 135-141, 168-180, 187-208, 216-224, 244-254, 256-264, 290-312, 322-330, 356-366, 374-384, 391-414, 421-428, 430-437, 442-449, 455-461, 464-479, 483-492, 501-512, 548-555, 862-868, 871-876, 891-904 |
| 2351 | ORF0418 | aureolysin | 10-29, 46-56, 63-74, 83-105, 107-114, 138-145, 170-184, 186-193, 216-221, 242-248, 277-289, 303-311, 346-360, 379-389, 422-428, 446-453, 459-469, 479-489, 496-501 |
| 2359 | ORF0409 | ISSP, immunogenic secreted protein precursor, putative | 4-29, 92-99, 119-130, 228-236, 264-269, 271-280, 311-317, 321-331, 341-353, 357-363, 366-372, 377-384, 390-396, 409-415, 440-448, 458-470, 504-520, 544-563, 568-581, 584-592, 594-603, 610-616 |
| 2378 | ORF0398 | SrpA | 18-23, 42-55, 69-77, 85-98, 129-136, 182-188, 214-220, 229-235, 242-248, 251-258, 281-292, 309-316, 333-343, 348-354, 361-367, 393-407, 441-447, 481-488, 493-505, 510-515, 517-527, 530-535, 540-549, 564-583, 593-599, 608-621, 636-645, 656-670, 674-687, 697-708, 726-734, 755-760, 765-772, 785-792, 798-815, 819-824, 826-838, 846-852, 889-904, 907-913, 932-939, 956-964, 982-1000, 1008-1015, 1017-1024, 1028-1034, 1059-1065, 1078-1084, 1122-1129, 1134-1143, 1180-1186, 1188-1194, 1205-1215, 1224-1230, 1276-1283, 1333-1339, 1377-1382, 1415-1421, |

TABLE 2a-continued

Immunogenic proteins identified by bacterial surface and ribosome display: s. aureus

| | | | |
|---|---|---|---|
| | | | 1448-1459, 1467-1472, 1537-1545, 1556-1566, 1647-1654, 1666-1675, 1683-1689, 1722-1737, 1740-1754, 1756-1762, 1764-1773, 1775-1783, 1800-1809, 1811-1819, 1839-1851, 1859-1866, 1876-1882, 1930-1939, 1947-1954, 1978-1985, 1999-2007, 2015-2029, 2080-2086, 2094-2100, 2112-2118, 2196-2205, 2232-2243 |
| 2466 | ORF0302 | YycH protein | 16-38, 71-77, 87-94, 105-112, 124-144, 158-164, 169-177, 180-186, 194-204, 221-228, 236-245, 250-267, 336-343, 363-378, 385-394, 406-412, 423-440, 443-449 |
| 2470 | ORF0299 | Conserved hypothetical protein | 4-9, 17-41, 50-56, 63-69, 82-87, 108-115, 145-151, 207-214, 244-249, 284-290, 308-316, 323-338, 348-358, 361-378, 410-419, 445-451, 512-522, 527-533, 540-546, 553-558, 561-575, 601-608, 632-644, 656-667, 701-713, 727-733, 766-780 |
| 2498 | ORF0267 | Conserved hypothetical protein | 33-43, 45-51, 57-63, 65-72, 80-96, 99-110, 123-129, 161-171, 173-179, 185-191, 193-200, 208-224, 227-246, 252-258, 294-308, 321-329, 344-352, 691-707 |
| 2548 | ORF2711 | IgG binding protein A | 4-16, 24-57, 65-73, 85-91, 95-102, 125-132, 146-152, 156-163, 184-190, 204-210, 214-221, 242-252, 262-268, 272-279, 300-311, 320-337, 433-440, 472-480, 505-523 |
| 2577 | ORF2683 | Hypothetical protein | 4-21, 49-56, 65-74, 95-112, 202-208, 214-235 |
| 2642 | ORF2614 | unknown | 34-58, 63-69, 74-86, 92-101, 130-138, 142-150, 158-191, 199-207, 210-221, 234-249, 252-271 |
| 2664 | ORF2593 | Conserved hypothetical protein | 7-37, 56-71, 74-150, 155-162, 183-203, 211-222, 224-234, 242-272 |
| 2670 | ORF2588 | Hexose transporter | 18-28, 36-49, 56-62, 67-84, 86-95, 102-153, 180-195, 198-218, 254-280, 284-296, 301-325, 327-348, 353-390, 397-402, 407-414, 431-455 |
| 2680 | ORF2577 | Coagulase | 4-18, 25-31, 35-40, 53-69, 89-102, 147-154, 159-165, 185-202, 215-223, 284-289, 315-322, 350-363, 384-392, 447-453, 473-479, 517-523, 544-550, 572-577, 598-604, 617-623 |
| 2740 | ORF2515 | Hypothetical protein | 5-44, 47-55, 62-68, 70-78, 93-100, 128-151, 166-171, 176-308 |
| 2746 | ORF2507 | homology with ORF1 | 5-12, 15-20, 43-49, 94-106, 110-116, 119-128, 153-163, 175-180, 185-191, 198-209, 244-252, 254-264, 266-273, 280-288, 290-297 |
| 2797 | ORF2470 | unknown | 10-27, 37-56, 64-99, 106-119, 121-136, 139-145, 148-178, 190-216, 225-249, 251-276, 292-297, 312-321, 332-399, 403-458 |
| 2798 | ORF2469 | Lipase (geh) | 12-35, 93-99, 166-179, 217-227, 239-248, 269-276, 288-294, 296-320, 322-327, 334-339, 344-356, 362-371, 375-384, 404-411, 433-438, 443-448, 455-464, 480-486, 497-503, 516-525, 535-541, 561-570, 579-585, 603-622, 633-641 |
| 2815 | ORF2451 | Conserved hypothetical protein | 5-32, 34-49 |
| 2914 | ORF2351 | metC | 39-44, 46-80, 92-98, 105-113, 118-123, 133-165, 176-208, 226-238, 240-255, 279-285, 298-330, 338-345, 350-357, 365-372, 397-402, 409-415, 465-473, 488-515, 517-535, 542-550, 554-590, 593-601, 603-620, 627-653, 660-665, 674-687, 698-718, 726-739 |

TABLE 2a-continued

Immunogenic proteins identified by bacterial surface
and ribosome display: s. aureus

| | | | |
|---|---|---|---|
| 2960 | ORF2298 | putative Exotoxin | 13-36, 40-49, 111-118, 134-140, 159-164, 173-183, 208-220, 232-241, 245-254, 262-271, 280-286, 295-301, 303-310, 319-324, 332-339 |
| 2963 | ORF2295 | putative Exotoxin | 13-28, 40-46, 69-75, 86-92, 114-120, 126-137, 155-172, 182-193, 199-206, 213-221, 232-238, 243-253, 270-276, 284-290 |
| 3002 | ORF1704 | homology with ORF1 | 4-21, 28-40, 45-52, 59-71, 92-107, 123-137, 159-174, 190-202, 220-229, 232-241, 282-296, 302-308, 312-331 |
| 3200 | ORF1331 | putative extracellular matrix binding protein | 6-15, 22-32, 58-73, 82-88, 97-109, 120-131, 134-140, 151-163, 179-185, 219-230, 242-255, 271-277, 288-293, 305-319, 345-356, 368-381, 397-406, 408-420, 427-437, 448-454, 473-482, 498-505, 529-535, 550-563, 573-580, 582-590, 600-605, 618-627, 677-685, 718-725, 729-735, 744-759, 773-784, 789-794, 820-837, 902-908, 916-921, 929-935, 949-955, 1001-1008, 1026-1032, 1074-1083, 1088-1094, 1108-1117, 1137-1142, 1159-1177, 1183-1194, 1214-1220, 1236-1252, 1261-1269, 1289-1294, 1311-1329, 1336-1341, 1406-1413, 1419-1432, 1437-1457, 1464-1503, 1519-1525, 1531-1537, 1539-1557, 1560-1567, 1611-1618, 1620-1629, 1697-1704, 1712-1719, 1726-1736, 1781-1786, 1797-1817, 1848-1854, 1879-1890, 1919-1925, 1946-1953, 1974-1979 |

| S. aureus antigenic protein | No. of selected clones per ORF and screen | Location of identified immunogenic region | Serum reactivity with relevant region (positive/total) | Seq ID no: (DNA + Prot) |
|---|---|---|---|---|
| SaA0003 | C: 3 | aa 112-189 | C: GSBYM94(112-189): 26/30 | 171, 172 |
| SaA0003 | C: 18 | aa 9-42 aa 158-174 | C: GSBYI53(9-42): 1/1 | 150, 158 |
| 0093 | A: 1, D: 5, C: 1, F: 6, G: 2 | aa 98-182 aa 684-764 aa 836-870 | A: GSBXL70(98-182): 9/30 D: n.d. C: GSBYH73(815-870): 3/16 | 34, 86 |
| 0095 | C: 12, E: 2 | aa 147-192 | C: GSBYH31(147-192): 2/14 E: GSBZA27(144-162): 23/41 | 145, 153 |
| 0123 | B: 3, E: 7, G: 1 | aa 168-181 | B: GSBXF80(168-181): 5/27 E: GSBZC17(168-181): 25/41 | 35, 87 |
| 0160 | A: 1 | aa 112-188 | A: GSBXO07(112-188): 5/30 | 36, 88 |
| 0222 | A: 52, C: 18*, H: 19 | aa 45-105 aa 103-166 aa 66-153 | A: GSBXM63(65-95): 1/1 A: GSBXM82(103-166): 14/29 A: GSBXK44-bmd3(65-153): 47/51 | 37, 89 |
| 0308 | A: 6, B: 2, C: 47, E: 35 | complement bp 474-367 | A: GSBXK03(bp473-367): 28/69 B: GSBXD29(bp465-431): 10/27 | 38, 90 |
| 0317 | A: 1 | aa 1-19 | A: GSBXP37(1-19): 6/29 | 39, 91 |
| 0337 | D: 12 | aa 8-48 | D: n.d. | 40, 92 |
| 0358 | C: 1, D: 2, E: 1 | aa 706-809 | D: n.d. | 41, 93 |

TABLE 2a-continued

Immunogenic proteins identified by bacterial surface and ribosome display: *s. aureus*

| | | | | |
|---|---|---|---|---|
| 0360 | A: 46, B: 21, C: 11, E: 2, F: 18, G: 7, H: 12 | aa 22-56 aa 23-99 aa 97-115 aa 233-250 aa 245-265 | A: GSBXK24(23-55): 1/1 B: GSBXB43(39-54): 58/71 A: GSBXK02-bmd1(22-99): 59/59 B: GSBXD82-bdb19(97-115): 1/1 F: SALAL03(233-250): 15/41 | 42, 94 |
| 0453 | C: 3 | aa 55-101 | C: GSBYG07(55-101): 1/1 | 146, 154 |
| 0569 | A: 1, F: 1 | aa 174-249 | A: GSBXS51(174-249): 11/30 | 32, 84 |
| 0576 | A: 21, B: 46, C: 55, E: 5, F: 85, H: 19 | aa 6-66 aa 65-124 aa 579-592 aa 590-604 | A: GSBXN93(6-66): 5/16 C: GSBYH05(45-144): 7/8 A: GSBXK66-bmd18(65-124): 16/30 B: GSBXB89(108-123): 1/1 B: GSBXB02(590-603): 39/71 F: SALAM15(579-592): 25/41 | 31, 83 |
| 0657 | A: 2, B: 27, F: 15 | aa 527-544 | B: GSBXE07-bdb1(527-542): 11/71 F: SALAX70(526-544): 11/41 | 1, 142 |
| 0749 | C: 2 | aa 630-700 | C: GSBYK17(630-700): 5/9 | 144, 152 |
| 944 | D: 4 | aa 483-511 | D: n.d. | 30, 82 |
| 1050 | A: 1, H: 45 | aa 57-128 | A: GSBXM26(57-128): 7/30 | 28, 80 |
| 1209 | B: 7, F: 8 | aa 167-181 | B: GSBXB76(167-179): 25/71 F: SALBC54(169-183): 18/41 | 54, 106 |
| 1344 | A: 11 | aa 34-94 | A: GSBXK59-bmd21(34-94): 6/29 | 5, 141 |
| 1356 | D: 12 | aa 1-49 | D: n.d. | 4, 57 |
| 1361 | A: 1, B: 23, E: 3, F: 31 | aa 37-49 aa 63-77 aa 274-334 | B: GSBXF81(37-49): 1/1 B: GSBXD45-bdb4(62-77): 12/70 A: GSBXL77(274-334): 5/30 F: SALAP81(62-77): 10/41 | 3, 56 |
| 1371 | C: 3, E: 2, G: 1 | aa 624-684 aa 891-905 | C: GSBYG95(624-684): 7/22 E: GSBZB45(891-905): 10/41 | 143, 151 |
| 1491 | A: 7, C: 2, E: 7, F: 4 | aa 39-94 | A: GSBXM13(39-94): 10/29 F: SALAY30(39-53): 4/41 | 2, 55 |
| 1616 | A: 10 | aa 158-220 | A: GSBXK06(158-220): 8/29 | 27, 79 |
| 1618 | A: 13, B: 3, C: 36, E: 4, F: 12, G: 2, H: 10 | aa 31-61 aa 58-74 | A: GSBXK60(31-61): 20/29 B: GSBXB48(58-74): 49/71 F: SALAY41(58-74): 30/41 | 26, 78 |
| 1632 | B: 6, E: 11, F: 34 | aa 105-119 aa 126-143 aa 168-186 | B: GSBXG53(168-186): 39/71 F: SALAP07(105-119): 11/41 | 25, 77 |
| 1763 | C: 3 | complement bp 237-170 | C: GSBYI30(98aa): 1/1 | 24, 75 |
| 1845 | D: 5, F: 2 | aa208-224 aa 672-727 | D: n.d. | 23, 75 |

TABLE 2a-continued

Immunogenic proteins identified by bacterial surface and ribosome display: *s. aureus*

| | | | | |
|---|---|---|---|---|
| 1951 | A: 223, B: 56, C: 167, E: 43, F: 100, G: 13, H: 102 | aa 137-237 aa 250-267 | B: GSBXC07(180-190): 1/1 A: GSBXK29(177-195): 15/29 B: GSBXD43(250-267): 10/71 F: SALAM13(178-191): 20/41 | 22, 74 |
| 1955 | A: 1, B: 3, E: 1, F: 8 | aa 38-52 aa 66-114 | A: GSBXR10(66-114): 5/30 F: SALAM67(37-52): 16/41 | 21, 73 |
| 2031 | B: 2, F: 2 | aa 59-74 | B: GSBXC01(59-71): 11/26 | 20, 72 |
| 2086 | A: 1, B: 8, E: 24, F: 9, G: 137 | aa 208-287 aa 261-276 aa 286-314 | A: GSBXS55(208-287): 38/46 B: GSBXB34(299-314):: 11/71 F: SALAX32(261-276): 21/41 | 19, 71 |
| 2180 | A: 3, C: 3, E: 6, F: 2, H: 6 | aa 493-587 aa 633-715 aa 704-760[#] aa 760-832 (aa 832-887)[#] | A: GSBXS61(493-555): 1/1 A: GSBXL64(496-585): 1/1 A: GSBXS92(760-841): 1/1 A: bmd4(704-760): 16/30[#] (A: bmd4(830-885): 16/30)[#] F: SALBC43(519-533): 4/41 | 18, 70 |
| 2184 | A: 2, C: 4, G: 9 | aa 701-777 aa 783-822 | A: GSBXM62(702-777): 28/28 A: GSBXR22(783-855): 1/1 | 17, 69 |
| 2186 | A: 4, C: 4, D: 5, E: 2 | aa 710-787 as 855-975 aa 916-983 | C: GSBYN05(710-787): 19/25 D: n.d. A: GSBXP01(916-983): 17/30 | 16, 68 |
| 2224 | B: 2 | aa 34-46 | B: GSBXD89(34-46): 1/1 | 15, 67 |
| 2254 | D: 3 | aa 403-462 | D.n.d. | 14, 66 |
| 2264 | A: 131, B: 51, C: 13, E: 43, F: 78, G: 2, H: 17 | aa 7-87 aa 133-242 | A: GSBXP22(145-196): 1/1 A: GSBXK05-bmd16(178-218): 6/29 B: GSBXE24-bdb20(167-178): 1/1 F: SALAQ91(173-184): 15/41 | 13, 65 |
| 2268 | A: 7, B: 65, C: 3, E: 2, F: 53 | aa 67-116 aa 98-184 aa 182-225 | A: GSBXK88(67-116): 1/1 A: GSBXN19(98-184): 22/29 A: GSBXN32(182-225): 34/71 B: GSBXB71(196-209): 16/29 F: SALAL22(196-210): 16/41 | 12, 64 |
| 2344 | D: 9, E: 1, F: 3, H: 4 | aa 706-762 aa 810-852 | D: n.d. | 11, 63 |
| 2351 | A: 1, C: 6 | aa 83-156 | A: GSBXO46(83-156): 14/29 | 10, 62 |
| 2359 | B: 4, F: 11 | aa 168-184 aa 206-220 aa 297-309 | B: GSBXD01(168-184): 1/1 B: GSBXD62(205-220): 1/1 B: GSBXC17(297-309): 6/27 F: SALAL04(205-220): 9/41 | 9, 61 |

TABLE 2a-continued

Immunogenic proteins identified by bacterial surface
and ribosome display: *s. aureus*

| | | | | |
|---|---|---|---|---|
| 2378 | C: 1, D: 7, F: 4, H: 11 | aa 198-258 aa 646-727 aa 846-857 aa 2104-2206 | C: GSBYI73(646-727): 2/9 F: SALAO33(846-857): 10/41 D: n.d. | 8, 60 |
| 2466 | D: 14 | aa 401-494 | D: n.d. | 7, 59 |
| 2470 | C: 3 | aa 414-455 | C: GSBYH60(414-455): 28/31 | 169, 170 |
| 2498 | D: 12 | aa 358-411 aa 588-606 | D: 17/21 | 6, 58 |
| 2548 | A: 55, B: 54, C: 35, F: 59, G: 56, H: 38 | aa 1-48 aa 47-143 aa 219-285 aa 345-424 | A: GSBXK68(1-73): 21/30 A: GSBXK41(47-135): 1/1 A: GSBXN38(219-285): 19/30 A: GSBXL11(322-375): 10/30 B: GSBXB22(406-418): 37/71 F: SALAM17(406-418): 29/41 | 53, 105 |
| 2577 | C: 6 | aa 99-171 | C: GSBYL56(99-171): 1/1 | 149, 157 |
| 2642 | C: 1, E: 1 | aa 5-48 | C: bhe3(5-48): 25/30## | 52, 104 |
| 2664 | D: 35 | aa 77-128 | D: n.d. | 51, 103 |
| 2670 | D: 16 | aa 328-394 | D: n.d. | 50, 102 |
| 2680 | C: 26, G: 4, H: 8 | aa 438-516 aa 505-570 aa 569-619 | C: GSBYHI6(438-516): 3/5 C: GSBYG24(505-570): 1/7 C: GSBYL82(569-619): 2/7 | 148, 156 |
| 2740 | D: 4 | aa 1-59 | D: n.d. | 49, 101 |
| 2746 | A: 1, H: 13 | aa 63-126 | A: GSBXO40(66-123): 8/29 | 48, 100 |
| 2797 | B: 3, E: 2, F: 13, H: 3 | aa 183-200 aa 349-363 | B: GSBXE85(183-200): 11/27 F: SALAQ47(183-200): 8/41 | 47, 99 |
| 2798 | A: 41, B: 42, C: 3, F: 35, G: 1, H: 11 | aa 48-136 aa 128-172 aa 201-258 | C: GSBYG01(48-136): 2/6 A: GSBXM31-bmd12(128-188): 11/30 B: GSBXE16(165-177): 10/30 A: GSBXN20(201-258): 8/30 F: SALAW05(165-177): 13/41 | 46, 98 |
| 2815 | D: 21 | aa 1-43 | D: n.d. | 45, 97 |
| 2914 | A: 1, C: 14, F: 2 | aa 386-402 | A: GSBXM18(386-402): 17/29 | 44, 96 |
| 2960 | C: 101, E: 2, H: 58 | aa 1-85 aa 54-121 aa 103-195 | C: GSBYG32(1-85):: 6/7 C: GSBYG61-bhe2(54-121): 26/30 C: GSBYN80(103-195): 13/17 | 43, 95 |
| 2963 | C: 3, E: 3, G: 1 | aa 22-100 | C: GSBYJ58(22-100): 9/15 | 147, 155 |
| 3002 | A: 2, C: 1, H: 4 | aa 21-118 | A: GSBXL06(21-118): 50/52 | 33, 85 |
| 3200 | A: 11, B: 11, C: 36 | aa 5-134 | A: GSBXL07(5-134): 6/28 | 29, 81 |

Bacterial surface display: A, LSA250/1 library in fhuA with patient sera 1 (655); B, LSA50/6 library in lamB with patient sera 1 (484); C, LSA250/1 library in fhuA with IC sera 1 (571); E, LSA50/6 library in lamB with IC sera 2 (454); F, LSA50/6 library in lamB with patient sera P1 (1105); G, LSA50/6 library in lamb with IC sera 1 (471)); H, LSA250/1 library in fhuA with patient sera 1 (IgA, 708). Ribosome display: D, LSA250/1 library with IC sera (1686).
*identified 18 times of 33 screened; was therefore eliminated from screen C.
**prediction of antigenic sequences longer than 5 amino acids was performed with the programme ANTIGENIC (Kolaskar and Tongaonkar, 1990);
identical sequence present twice in ORF;
clone not in database (not sequence by TIGR).

TABLE 2b

Additional immunogenic proteins identified by bacterial surface and ribosome display: *S. aureus*

| *S. aureus* antigenic protein | Putative function (by homology) | predicted immunogenic aa** | No. of selected clones per ORF and screen | Location of identified immunogenic region | Serum reactivity with relevant region (positive/total) | Seq ID no: (DNA + Prot) |
|---|---|---|---|---|---|---|
| ARF0280 | Putative protein | 7-14 | F: 6 | aa 25-43 | SALAM59(25-43): 1/1 | 401, 402 |
| CRF0145 | Putative protein | 18-28, 31-37, 40-47, 51-83, 86-126 | F: 5 | aa 81-90 | SALAZ40(81-90): 2/12 | 403, 404 |
| CRF0250 | Putative protein | 4-24, 26-46, 49-86 | G: 8 | aa 60-76 | SALAJ87(60-76): n.d. | 365, 378 |
| CRF0308 | Putative protein | 40-46 | A: 6, B: 2, C: 47, E: 35 | aa 5-38 | A: GSBXK03(7-36): 28/69 B: GSBXD29(10-20): 10/27 | 391, 392 |
| CRF0337 | Unknown | 4-17 | D: 3 | aa 1-20 | D: n.d. | 469; 486 |
| CRF0497 | Putative protein | 4-28, 31-53, 58-64 | B: 13, F: 5 | aa 18-34 | GSBXF31(19-34): 1/7 | 366, 379 |
| CRF0538 | Unknown | 4-20 | D: 7 | aa 1-11 | D: n.d. | 470; 487 |
| CRF0750 | Putative protein | 4-11, 18-24, 35-40 | G: 44 | aa 25-39 | SALAG92(26-39): n.d. | 367, 380 |
| CRF1145 | Unknown | 4-57 | D: 28 | aa 16-32 | D: n.d. | 464; 481 |
| CRF1247 | Putative protein | 4-25, 27-56 | F: 6 | aa 36-46 | SALAR23(36-46): n.d. | 368, 381 |
| CRF1256 | Putative protein | 19-25, 38-47, 55-74, 77-87 | G: 5 | aa 54-67 | SALAG65(54-67): n.d. | 369, 382 |
| CRF1356 | Unknown | 8-15; 18-24; 27-38 | D: 5 | aa 5-33 | D: n.d. | 471; 488 |
| CRF1763 | Putative protein | 4-9, 23-41, 43-58, 71-85 | C: 3 | aa 1-22 | C: GSBYI30(1-22): 1/1 | 407, 408 |
| CRF1783 | Unknown | 8-161 | D: 5 | aa 76-127 | D: n.d. | 465; 482 |
| CRF1845 | Unknown | 4-28; 30-36 | D: 272 | aa 1-17 | D: n.d. | 472; 489 |
| CRF1861 | Unknown | 6-11; 13-34; 36-50 | D: 8 | aa 4-27 | D: n.d. | 466; 483 |
| CRF1928 | Putative protein | 4-9, 17-30 | F: 9 | aa 13-22 | SALAR41(13-22): n.d. | 370, 383 |
| CRF2004 | Putative protein | 18-38 | F: 13 | aa 16-32 | SALAM75(16-32): n.d. | 371, 384 |
| CRF2155 | Putative protein | 4-15, 30-58 | F: 9 | aa 54-66 | SALAQ54(54-66): 1/12 | 372, 385 |
| CRF2180 | Putative protein | 4-61, 65-72, 79-95, 97-106 | E: 13 | aa 86-99 | GSBZE08(86-99): n.d. | 373, 386 |
| CRF2207 | Unknown | 4-13 | D: 3 | aa 17-39 | D: n.d. | 473; 490 |
| CRF2305 | Putative protein | 4-9, 22-33, 44-60 | C: 5 | aa 80-116 | GSBYL75(80-116): n.d. | 374, 387 |
| CRF2341 | Putative protein | 4-23, 30-44, 49-70 | F: 8 | aa 46-55 | SALAW31(46-55): n.d. | 375, 388 |
| CRF2349 | Putative protein | 4-32, 39-46, 62-69, 77-83 | B: 10, F: 4 | aa 46-67 | GSBXC92(52-67): 2/11 | 376, 389 |
| CRF2356 | Unknown | 4-18 | D: 3 | aa 3-18 | D: n.d. | 475; 492 |
| CRF2452 | Unknown | 4-31 | D: 9 | aa 7-21 | D: n.d. | 476; 493 |
| CRF2498 | Putative protein | 4-29, 31-41 | G: 8 | aa 2-15 | SALAF30(3-15): n.d. | 377, 390 |
| CRF2553 | Unknown | 4-35; 37-42 | D: 4 | aa 1-20 | D: n.d. | 474; 491 |
| CRF2578 | Unknown | 5-25; 30-39 | D: 11 | aa 9-30 | D: n.d. | 467; 484 |
| CRF2664 | Unknown | 11-21 | D: 17 | aa 1-14 | D: n.d. | 477; 494 |
| CRF2729 | Putative protein | 10-41, 50-57 | F: 3 | aa 40-56 | SALAQ25(40-56): 1/1 | 405, 406 |
| CRF2863/1 | Unknown | 4-43 | D: 78 | aa 17-40 | D: n.d. | 478; 495 |
| CRF2863/2 | Unknown | 4-46 | D: 78 | aa 44-49 | D: n.d. | 479; 496 |
| CRFA002 | Unknown | 17-39; 52-59 | D: 3 | aa 38-55 | D: n.d. | 463; 480 |
| CRFNI | Unknown | 5-20; 37-44; 52-59; 87-94; 116-132 | D: 4 | aa 94-116 | D: n.d. | 468; 485 |
| ORF0188 | UDP-N-acetyl-D-mannosamine transferase, putative | 11-18, 43-56, 58-97, 100-118, 120-148, 152-171, 195-203, 207-214, 220-227, 233-244 | B: 4, F: 29 | aa 197-210 | SALAM14(198-209): n.d. | 397, 398 |
| ORF0254 | Multidrug efflux transporter | 4-33, 35-56, 66-99, 109-124, 136-144, 151-180, 188-198, 201-236, 238-244, 250-260, 266-290, 294-306, 342-377 | D: 3 | aa 155-175 | D: n.d. | 297, 325 |
| ORF0307 | Conserved hypothetical protein | 4-23, 25-67, 76-107, 109-148 | D: 3 | aa 9-44 | D: n.d. | 298, 326 |
| ORF0452 | Conserved hypothetical protein | 4-35, 41-47, 55-75, 77-89, 98-113, 116-140, 144-179, 194-215, 232-254, 260-273, 280-288, 290-302, 315-323, 330-369, 372-385, 413-432 | D: 5 | aa 105-122 | D: n.d. | 299, 327 |
| ORF0456 | Na+/H+Antiporter | 4-81 | D: 66 | aa 1-21 | D: n.d. | 300, 328 |
| ORF0556 | Iron(III)dicitrate binding protein | 5-23, 50-74, 92-99, 107-122, 126-142, 152-159, 172-179, 188-196, 211-218, 271-282 | D: 10 | aa 1-18 | D: n.d. | 301, 329 |
| ORF0629 | Hypothetical Protein | 9-44, 63-69, 75-82, 86-106, 108-146, 153-161, 166-178, 185-192, 233-239, 258-266, 302-307 | D: 313 | aa 13-37 | D: n.d. | 302, 330 |
| ORF0637 | GTP-binding protein TypA | 10-19, 22-32, 95-105, 112-119, 121-133, 140-154, 162-174, 186-200, 207-224, 238-247, 254-266, 274-280, 288-294, 296-305, 343-351, 358-364, 366-373, 382-393, 403-413, 415-422, 440-447, 499-507, 565-575, 578-588 | F: 3 | aa 107-119 | F: SALAX70(107-119): 10/41 | 393, 395 |
| ORF0713 | Conserved hypothetical transmembrane protein, putative | 22-51, 53-71, 80-85, 93-99, 105-112, 123-146, 151-157, 165-222, 226-236, 247-270, 290-296, 301-324, 330-348, 362-382, 384-391, 396-461, 463-482, 490-515 | D: 3 | aa 487-513 | D: n.d. | 303, 331 |

TABLE 2b-continued

Additional immunogenic proteins identified by bacterial surface and ribosome display: *S. aureus*

| *S. aureus* antigenic protein | Putative function (by homology) | predicted immunogenic aa** | No. of selected clones per ORF and screen | Location of identified immuno- genic region | Serum reactivity with relevant region (positive/total) | Seq ID no: (DNA + Prot) |
|---|---|---|---|---|---|---|
| ORF0788 | Cell division protein | 104-111, 158-171, 186-197, 204-209, 230-247, 253-259, 269-277, 290-314, 330-340, 347-367, 378-388 | D: 4 | aa 152-178 | D: n.d. | 304, 332 |
| ORF0797 | Conserved hypothetical protein | 11-40, 56-75, 83-102, 112-117, 129-147, 154-168, 174-191, 196-270, 280-344, 354-377, 380-429, 431-450, 458-483, 502-520, 525-532, 595-602, 662-669, 675-686, 696-702, 704-711, 720-735, 739-748, 750-756, 770-779, 793-800, 813-822, 834-862 | D: 12 | aa 196-218 | D: n.d. | 305, 333 |
| ORF0836 | Cell Division Protein | 34-91, 100-119, 126-143, 147-185, 187-197, 319-335, 349-355, 363-395, 397-412, 414-422, 424-440, 458-465, 467-475, 480-505, 507-529, 531-542, 548-553, 577-589, 614-632, 640-649, 685-704, 730-741, 744-751, 780-786 | D: 5 | aa 26-56 | D: n.d. | 306, 334 |
| ORF1318 | Amino acid permease | 11-21, 25-32, 34-54, 81-88, 93-99, 105-117, 122-145, 148-174, 187-193, 203-218, 226-260, 265-298, 306-318, 325-381, 393-399, 402-421, 426-448 | D: 8 | aa127-152 | D: n.d. | 307, 335 |
| ORF1321 | Pyruvat kinase | 4-11, 50-67, 89-95, 103-109, 112-135, 139-147, 158-170, 185-204, 213-219, 229-242, 248-277, 294-300, 316-323, 330-335, 339-379, 390-402, 408-422, 431-439, 446-457, 469-474, 484-500, 506-513, 517-530, 538-546, 548-561 | E: 6 | aa 420-432 | E: GSBZE16(420-432): 5/41 | 197, 216 |
| ORF1388 | LPXTG cell wall anchor motif | 11-31, 86-91, 103-111, 175-182, 205-212, 218-226, 242-247, 260-269, 279-288, 304-313, 329-334, 355-360, 378-387, 390-399, 407-435, 468-486, 510-516, 535-547, 574-581, 604-615, 635-646, 653-659, 689-696, 730-737, 802-812, 879-891, 893-906, 922-931, 954-964, 997-1009, 1031-1042, 1089-1096, 1107-1120, 1123-1130, 1149-1162, 1176-1184, 1192-1207, 1209-1215, 1253-1259, 1265-1275, 1282-1295, 1304-1310, 1345-1361, 1382-1388, 1394-1400, 1412-1430, 1457-1462, 1489-1507, 1509-1515, 1535-1540, 1571-1591, 1619-1626, 1635-1641, 1647-1655, 1695-1701, 1726-1748, 1750-1757, 1767-1783, 1802-1807, 1809-1822, 1844-1875, 1883-1889, 1922-1929, 1931-1936, 1951-1967, 1978-1989, 1999-2008, 2023-2042, 2056-2083, 2101-2136, 2161-2177 | D: 3 | aa 508-523 | D: n.d. | 308, 336 |
| ORF1402 | 3,4-dihydroxy-2-butanone-4-phosphate synthase | 18-23, 32-37, 54-63, 65-74, 83-92, 107-114, 123-139, 144-155, 157-164, 191-198, 232-240, 247-272, 284-290, 295-301, 303-309, 311-321, 328-341, 367-376 | E: 3 | aa 121-137 | E: GSBZB68(121-137): 7/41 | 198, 217 |
| ORF1473 | hemolysin II (LukD-Leuktoxin) | 4-36, 39-47, 57-65, 75-82, 108-114, 119-126, 135-143, 189-195, 234-244, 250-257, 266-272, 311-316 | F: 1 | aa 245-256 | F: SALAP76(245-256): 6/41 | 199, 218 |
| ORF1523 | Iron uptake regulator | 13-27, 29-44, 46-66, 68-81, 97-116, 138-145 | D: 3 | aa 120-135 | D: n.d. | 309, 337 |
| ORF1707 | inner membrane protein, 60 kDa | 4-23, 57-77, 89-103, 119-125, 132-172, 179-197, 210-254, 256-265, 281-287 | F: 1 | aa 104-118 | F: SALBC82(104-118): 7/41 | 200, 219 |
| ORF1754 | amiB | 5-10, 16-24, 62-69, 77-96, 100-115, 117-126, 137-156, 165-183, 202-211, 215-225, 229-241, 250-260, 267-273, 290-300, 302-308, 320-333, | D: 3 | aa 293-312 | D: n.d. | 310, 338 |

TABLE 2b-continued

Additional immunogenic proteins identified by bacterial surface and ribosome display: *S. aureus*

| S. aureus antigenic protein | Putative function (by homology) | predicted immunogenic aa** | No. of selected clones per ORF and screen | Location of identified immuno-genic region | Serum reactivity with relevant region (positive/total) | Seq ID no: (DNA + Prot) |
|---|---|---|---|---|---|---|
| | | 336-342, 348-356, 375-382, 384-389 | | | | |
| ORF1783 | Mrp protein (fmtB) | 5-29, 46-52, 70-76, 81-87, 155-170, 192-197, 206-213, 215-220, 225-231, 249-258, 273-279, 281-287, 300-306, 313-319, 323-332, 335-341, 344-351, 360-382, 407-431, 443-448, 459-468, 475-496, 513-520, 522-537, 543-550, 556-565, 567-573, 580-585, 593-615, 619-631, 633-642, 670-686, 688-698, 759-766, 768-782, 799-808, 842-848, 868-877, 879-917, 945-950, 979-988, 996-1002, 1025-1036, 1065-1084, 1101-1107, 1113-1119, 1125-1142, 1163-1169, 1183-1189, 1213-1219, 1289-1301, 1307-1315, 1331-1342, 1369-1378, 1385-1391, 1410-1419, 1421-1427, 1433-1447, 1468-1475, 1487-1494, 1518-1529, 1564-1570, 1592-1609, 1675-1681, 1686-1693, 1714-1725, 1740-1747, 1767-1774, 1793-1807, 1824-1841, 1920-1937, 1953-1958, 1972-1978, 1980-1986, 1997-2011, 2048-2066, 2161-2166, 2219-2224, 2252-2257, 2292-2298, 2375-2380, 2394-2399, 2435-2440, 2449-2468 | F: 2 | aa 850-860 | F: SALAQ36(850-860): 8/41 | 201, 220 |
| ORF1848 | Map-ND2C protein | 4-27, 42-66, 70-76, 102-107, 113-118, 133-138 | E: 5 | aa 75-90 | E: GSBZB15(75-90): 6/41 | 202, 221 |
| ORF1891 | ribosomal protein L2 (rplB) | 31-39, 48-54, 61-67, 75-83, 90-98, 103-119, 123-145, 160-167, 169-176, 182-193, 195-206, 267-273 | F: 4 | aa 239-257 | F: SALAV36(239-257): 19/41 | 203, 222 |
| ORF2011 | Putative drug transporter | 5-27, 79-85, 105-110, 138-165, 183-202, 204-225, 233-259, 272-292, 298-320, 327-336, 338-345, 363-376, 383-398, 400-422, 425-470, 489-495, 506-518, 536-544, 549-554, 562-568, 584-598, 603-623 | D: 5 | aa 205-224 | D: n.d. | 311, 339 |
| ORF2027 | lactase permease, putative | 10-33, 38-71, 73-103, 113-125, 132-147, 154-163, 170-216, 222-248, 250-269, 271-278, 287-335, 337-355, 360-374, 384-408, 425-442, 453-465, 468-476, 478-501, 508-529 | E: 2 | aa 422-436 | E: GSBZF58(422-436): 6/41 | 204, 223 |
| ORF2087 | Hemolysin II (putative) | 8-27, 52-59, 73-80, 90-99, 104-110, 117-124, 131-140, 189-209, 217-232, 265-279, 287-293, 299-306 | D: 3 | aa 126-147 | D: n.d. | 312, 340 |
| ORF2090 | preLukS | 8-26, 75-82, 118-126, 136-142, 163-177, 182-189, 205-215, 221-236, 239-248, 268-274 | F: 2 | aa 270-284 | F: SALAQ77(270-284): 23/41 | 205, 224 |
| ORF2092 | Hemolysin II (preLUK-F) | 5-22, 30-47, 58-65, 75-81, 87-92, 99-105, 107-113, 119-126, 189-195, 217-223, 234-244, 250-257, 266-272 | F: 3 | aa 238-253 | F: SALAQ67(237-252): 10/41 | 206, 225 |
| ORF2107 | Multidrug resistance protein (putative) | 10-28, 30-43, 50-75, 80-113, 116-125, 136-167, 170-191, 197-245, 253-329, 345-367, 375-396 | D: 9 | aa 54-104 | D: n.d. | 313, 341 |
| ORF2192 | Transcriptional regulator GntR family, putative | 20-31, 46-52, 55-69, 74-79, 89-97, 108-113, 120-128, 141-171, 188-214 | D: 3 | aa 15-35 | D: n.d. | 314, 342 |
| ORF2305 | Amino acid permease | 25-79, 91-103, 105-127, 132-149, 158-175, 185-221, 231-249, 267-293, 307-329, 336-343, 346-359, 362-405, 415-442, 446-468 | D: 53 | aa 363-393 | D: n.d. | 315, 343 |
| ORF2324 | Citrate dransporter | 10-77, 85-96, 99-109, 111-138, 144-155, 167-176, 178-205, 225-238, 241-247, 258-280, 282-294, 304-309, 313-327, 333-383, 386-402, 405-422, 429-453 | D: 7 | aa 37-83 | D: n.d. | 316, 344 |

TABLE 2b-continued

Additional immunogenic proteins identified by bacterial surface and ribosome display: *S. aureus*

| S. aureus antigenic protein | Putative function (by homology) | predicted immunogenic aa** | No. of selected clones per ORF and screen | Location of identified immuno-genic region | Serum reactivity with relevant region (positive/total) | Seq ID no: (DNA + Prot) |
|---|---|---|---|---|---|---|
| ORF2422 | Anion transporter family protein | 7-26, 28-34, 36-53, 55-73, 75-81, 87-100, 108-117, 121-138, 150-160, 175-181, 184-195, 202-215, 221-247, 265-271, 274-314, 324-337, 341-412, 414-423, 425-440, 447-462, 464-469 | D: 16 | aa 275-295 | D: n.d. | 317, 345 |
| ORF2553 | SirA | 5-22, 54-78, 97-103, 113-123, 130-148, 166-171, 173-180, 192-201, 254-261, 266-272, 310-322 | D: 3 | aa 1-22 | D: n.d. | 318, 346 |
| ORF2555 | ornithine cyclode-aminase | 20-35, 37-50, 96-102, 109-120, 123-137, 141-150, 165-182, 206-224, 237-256, 267-273, 277-291, 300-305, 313-324 | E: 2 | aa 32-48 | E: GSBZB37(32-48): 11/41 | 207, 226 |
| ORF2558 | Multidrug resistance efflux proten, putative | 11-63, 79-129, 136-191, 209-231, 237-250, 254-276, 282-306, 311-345, 352-373, 376-397 | D: 8 | aa 84-100 | D: n.d. | 319, 347 |
| ORF2610 | Cap5M | 4-30, 34-40, 79-85, 89-98, 104-118, 124-139, 148-160, 167-178 | D: 13 | aa 114-141 | D: n.d. | 320, 348 |
| ORF2613 | Cap5P (UDP-N-acetylglucosamine 2-epimerase) | 4-9, 17-24, 32-38, 44-54, 68-82, 89-95, 101-120, 124-131, 136-142, 145-157, 174-181, 184-191, 196-204, 215-224, 228-236, 243-250, 259-266, 274-281, 293-301, 314-319, 325-331, 355-367, 373-378 | B: 3, F: 11 | aa 321-341 | F: SALAU27(325-337): 9/41 | 208, 227 |
| ORF2628 | Hypothetical protein | 9-15, 28-36, 44-62, 69-88, 98-104, 111-136, 139-149, 177-186, 195-217, 224-236, 241-257, 260-278, 283-290, 292-373, 395-408, 411-443, 465-472, 475-496, 503-520, 552-559, 569-589, 593-599, 607-613, 615-636, 648-654, 659-687, 689-696, 721-733, 738-759, 783-789, 795-801, 811-823, 827-836, 839-851, 867-875, 877-883, 890-898, 900-908, 912-931, 937-951, 961-992, 994-1002, 1005-1011, 1016-1060, 1062-1074, 1088-1096, 1101-1123, 1137-1153, 1169-1192, 1210-1220, 1228-1239, 1242-1251, 1268-1275, 1299-1311, 1322-1330, 1338-1361, 1378-1384, 1393-1412, 1419-1425, 1439-1459, 1469-1482, 1489-1495, 1502-1519, 1527-1544, 1548-1555, 1600-1607, 1609-1617, 1624-1657, 1667-1691, 1705-1723, 1727-1742, 1749-1770, 1773-1787, 1804-1813, 1829-1837, 1846-1852, 1854-1864, 1869-1879, 1881-1896, 1900-1909, 1922-1927, 1929-1935, 1942-1962, 1972-2005, 2009-2029, 2031-2038, 2055-2076, 2101-2114, 2117-2124, 2147-2178, 2188-2202, 2209-2217, 2224-2230, 2255-2266, 2271-2280, 2282-2302, 2307-2316, 2319-2324, 2379-2387 | F: 6 | aa 694-708 aa 790-800 aa 1288-1305 | F: SALBD82(1288-1303): 9/41 | 209, 228 |
| ORF2644 | PTS system, sucrose-specific IIBC component | 8-15, 24-30, 49-68, 80-93, 102-107, 126-147, 149-168, 170-180, 185-193, 241-305, 307-339, 346-355, 358-372, 382-390, 392-415, 418-425, 427-433, 435-444, 450-472 | F: 4 | aa 106-159 | F: SALAW60(106-125): 3/41 | 210, 229 |
| ORF2654 | Oligopeptide ABC transporter, putative | 5-61, 72-84, 87-99, 104-109, 124-145, 158-170, 180-188, 190-216, 223-264, 270-275, 296-336, 355-372 | D: 5 | aa 182-209 | D: n.d. | 321, 349 |
| ORF2662 | maltose ABC transporter, putative | 4-21, 71-79, 99-105, 110-121, 143-161, 199-205, 219-235, 244-258, 265-270, 285-291, 300-308, 310-318, 322-328, 346-351, 355-361, 409-416 | F: 1 | aa 306-323 | F: SALBC05(306-323): 2/41 | 211, 230 |

TABLE 2b-continued

Additional immunogenic proteins identified by bacterial surface and ribosome display: *S. aureus*

| S. aureus antigenic protein | Putative function (by homology) | predicted immunogenic aa** | No. of selected clones per ORF and screen | Location of identified immunogenic region | Serum reactivity with relevant region (positive/total) | Seq ID no: (DNA + Prot) |
|---|---|---|---|---|---|---|
| ORF2710 | sorbitol dehydrogenase | 4-12, 19-40, 61-111, 117-138, 140-153, 161-180, 182-207, 226-235, 237-249, 253-264, 267-274, 277-292, 311-323 | B: 2, F: 4 | aa 244-257 | F: SALAX93(249-256): 6/41 | 212, 231 |
| ORF2742 | Hypothetical protein | 4-41, 49-56, 61-67, 75-82, 88-104, 114-125, 129-145, 151-165, 171-178, 187-221, 224-230, 238-250, 252-275, 277-304, 306-385 | D: 188, H: 4 | aa 303-323 | D: n.d. | 322, 350 |
| ORF2780 | brnQ | 4-29, 41-63, 74-95, 97-103, 107-189, 193-209, 220-248, 260-270, 273-299, 301-326, 328-355, 366-397, 399-428 | D: 3 | aa 26-40 | D: n.d. | 323, 351 |
| ORF2806 | Phage related protein | 10-17, 23-29, 31-37, 54-59, 74-81, 102-115, 127-137, 145-152, 158-165, 178-186, 188-196, 203-210, 221-227, 232-237 | F: 3 | aa 104-116 | F: SALBC34: 1/1 | 213, 232 |
| ORF2900 | Conserved hypothetical protein | 4-27, 34-43, 62-73, 81-90, 103-116, 125-136, 180-205, 213-218, 227-235, 238-243, 251-259, 261-269, 275-280, 284-294, 297-308, 312-342, 355-380, 394-408, 433-458, 470-510, 514-536, 542-567 | D: 24 | aa 360-376 | D: n.d. | 324, 352 |
| ORF2931 | conserved hypothetical protein | 4-19, 43-54, 56-62, 84-90, 96-102, 127-135, 157-164, 181-187 | E: 6 | aa 22-37 | E: GSBZA13(22-37): 7/41 | 214, 233 |
| ORF2958 | Exotoxin 2 | 7-19, 26-39, 44-53, 58-69, 82-88, 91-107, 129-141, 149-155, 165-178, 188-194 | F: 1 | aa 154-168 | F: SALBB59(154-168): 4/41 | 215, 234 |
| ORF2970 | Surface protein, putative | 9-23, 38-43, 55-60, 69-78, 93-101, 103-112, 132-148, 187-193, 201-208, 216-229, 300-312, 327-352, 364-369, 374-383, 390-396, 402-410, 419-426, 463-475, 482-491 | H: 5 | aa 1-70 | H: GSBYU66: n.d. | 399, 400 |

Bacterial surface display: A, LSA250/1 library in fhuA with patient sera 1 (655); B, LSA50/6 library in lamB with patient sera 1 (484); C, LSA250/1 library in fhuA with IC sera 1 (571); E, LSA50/6 library in lamB with IC sera 2 (454); F, LSA50/6 library in lamB with patient sera P1 (1105); G, LSA50/6 library in lamb with IC sera 1 (471); H, LSA250/1 library in fhuA with patient sera I (IgA, 708). Ribosome display: D, LSA250/1 library with IC sera (1686).
**prediction of antigenic sequences longer than 5 amino acids was performed with the programme ANTIGENIC (Kolaskar and Tongaonkar, 1990). ORF, open reading frame; CRF, reading frame on complementary strand; ARF, alternative reading frame.

TABLE 2c

Immunogenic proteins identified by bacterial surface and ribosome display: *S. epidermidis*.

| S. epidermidis antigenic protein | Putative function (by homology) | predicted immunogenic aa** | No. of selected clones per ORF and screen | Location of identified immunogenic region | Serum reactivity with relevant region (positive/total) | Seq ID no: (DNA + Prot) |
|---|---|---|---|---|---|---|
| ARF0172 | cation-transporting ATPase, E1-E2 family | 4-34, 37-43 | D: 6 | aa3-32 | D: nd | 497, 548 |
| ARF0183 | condensing enzyme, putative, FabH-related | 4-22, 24-49 | D: 4 | aa1-52 | D: nd | 498, 549 |
| ARF2455 | NADH dehydrogenase, putative | 4-29 | D: 3 | aa1-22 | D: nd | 499, 550 |
| CRF0001 | Unknown | 4-14, 16-26 | D: 3 | aa5-21 | D: nd | 500, 551 |
| CRF0002 | Unknown | 4-13, 15-23, 36-62 | D: 5 | aa21-70 | D: nd | 501, 552 |
| CRF0003 | Unknown | 4-12, 14-28 | D: 3 | aa 4-31 | D: nd | 502, 553 |
| CRF0004 | Unknown | 5-15, 35-71, 86-94 | D: 4 | aa31-72 | D: nd | 503, 554 |

TABLE 2c-continued

Immunogenic proteins identified by bacterial surface and ribosome display: *S. epidermidis*.

| S. epidermidis antigenic protein | Putative function (by homology) | predicted immunogenic aa** | No. of selected clones per ORF and screen | Location of identified immunogenic region | Serum reactivity with relevant region (positive/total) | Seq ID no: (DNA + Prot) |
|---|---|---|---|---|---|---|
| CRF0005 | Unknown | 8-26, 28-34 | D: 3 | aa: 9-33 | D: nd | 504, 555 |
| CRF0006 | Unknown | 4-11, 15-28 | D: 3 | aa10-22 | D: nd | 505, 556 |
| CRF0007 | Unknown | 4-19, 30-36 | D: 3 | aa 7-44 | D: nd | 506, 557 |
| CRF0008 | Unknown | 10-48 | D: 4 | aa: 9-44 | D: nd | 507, 558 |
| CRF0009 | Unknown | 41883 | D: 3 | aa5-14 | D: nd | 508, 559 |
| CRF0192 | Putative protein | 4-23, 25-68 | C: 4 | aa 15-34 | C: GSBBM10(15-34): n.d. | 445, 446 |
| CRF0275 | Putative protein | 4-40, 49-65 | B: 5 | aa 35-68 | B: SELAK28(35-68): n.d. | 447, 448 |
| CRF0622 | Putative protein | 4-12, 17-57, 62-70, 75-84, 86-100 | C: 4 | aa 75-99 | C: GSBBR74(76-99): n.d. | 449, 450 |
| CRF0879 | Putative protein | 4-14, 38-44 | A: 3, B: 10 | aa 9-40 | B: SELAC39(10-40): n.d. | 451, 452 |
| CRF1004 | Putative protein | 4-40 | A: 3, B: 5 | aa 29-65 | B: SELAI63(35-63): n.d. | 453, 454 |
| CRF2248 | Putative protein | 4-10, 19-40, 53-64, 74-91 | C: 30 | aa 74-111 | C: GSBBN64(16-35): n.d. | 455, 456 |
| CRF2307 | Putative protein | 4-19, 35-41, 80-89 | A: 19 | aa 41-87 | A: SEFAL47(41-87): n.d. | 457, 458 |
| CRF2309 | Putative protein | 15-21 | B: 6 | aa 4-16 | B: SELAL02(4-16): n.d. | 459, 460 |
| CRF2409 | Putative protein | 6-25 | B: 6 | aa 2-24 | B: SELAB48(5-24): n.d. | 461, 462 |
| ORF0005 | hypothetical protein | 13-27, 33-67, 73-99, 114-129, 132-158, 167-190, 193-234, 237-267, 269-299, 316-330, 339-351, 359-382, 384-423 | D: 3 | aa105-128 | D: nd | 509, 560 |
| ORF0008 | Streptococcal hemagglutinin | 9-14, 16-24, 26-32, 41-50, 71-79, 90-96, 177-184, 232-237, 271-278, 293-301, 322-330, 332-339, 349-354, 375-386, 390-396, 403-409, 453-459, 466-472, 478-486, 504-509, 518-525, 530-541, 546-552, 573-586, 595-600, 603-622, 643-660, 668-673, 675-681, 691-697, 699-711, 713-726, 732-749, 753-759, 798-807, 814-826, 831-841, 846-852, 871-878, 897-904, 921-930, 997-1003, 1026-1031, 1033-1039, 1050-1057, 1069-1075, 1097-1103, 1105-1111, 1134-1139, 1141-1147, 1168-1175, 1177-1183, 1205-1211, 1213-1219, 1231-1237, 1241-1247, 1267-1273, 1304-1309, 1311-1317, 1329-1335, 1339-1345, 1347-1353, 1382-1389, 1401-1407, 1411-1417, 1447-1453, 1455-1461, 1483-1489, 1491-1497, 1527-1533, 1545-1551, 1556-1561, 1581-1587, 1591-1597, 1627-1638, 1661-1667, 1684-1689, 1691-1697, 1708-1715, 1719-1725, 1765-1771, 1813-1820, 1823-1830, 1835-1856 | B: 2 | aa 895-926 | B: SELAF79(895-926): 7/12 | 239, 268 |
| ORF0038 | extracellular elastase precursor | 6-25, 29-35, 39-45, 64-71, 82-88, 96-102, 107-113, 119-131, 170-176, 186-192, 196-202, 215-220, 243-248, 302-312, 345-360, 362-371, 378-384, 458-470, 478-489, 495-504 | C: 6 | aa 136-165 | C: GSBBN08(136-165): 1/1 | 353, 359 |
| ORF0099 | hypothetical protein | 6-18, 31-37, 42-49, 51-67, 73-85, 87-93, 102-109, 119-126, 150-157, 170-179, 185-191, 204-214, 217-223, 237-248, 269-275, 278-316, 320-340, 359-365 | D: 5 | aa218-265 | D: nd | 510, 561 |

TABLE 2c-continued

Immunogenic proteins identified by bacterial surface and ribosome display: *S. epidermidis*.

| S. epidermidis antigenic protein | Putative function (by homology) | predicted immunogenic aa** | No. of selected clones per ORF and screen | Location of identified immunogenic region | Serum reactivity with relevant region (positive/total) | Seq ID no: (DNA + Prot) |
|---|---|---|---|---|---|---|
| ORF0101 | hypothetical protein | 4-10, 15-27, 67-94, 123-129, 167-173, 179-184, 187-198, 217-222, 229-235, 238-246 | D: 18 | aa26-109 | D: nd | 511, 562 |
| ORF0121 | C4-dicarboxylate transporter, anaerobic, putative | 4-20, 24-62, 73-86, 89-106, 110-122, 131-164, 169-193, 204-213, 219-236, 252-259, 263-281, 296-306, 318-324, 328-352, 356-397, 410-429 | D: 5 | aa323-379 | D: nd | 512, 563 |
| ORF0143 | amino acid permease | 25-79, 91-103, 105-127, 132-150, 157-174, 184-206, 208-219, 231-249, 267-294, 310-329, 336-343, 346-405, 417-468 | D: 35 | aa247-339 | D: nd | 513, 564 |
| ORF0162 | Immunodominant Antigen A | 4-27, 35-45, 52-68, 83-89, 113-119, 133-150, 158-166, 171-176, 198-204, 219-230 | A: 11, B: 11; C: 153 | aa 90-227 | B: SELAA19(100-118): 1/1 B: SELAE24(170-190): 11/12 | 240, 269 |
| ORF0201 | capa protein, putative | 10-17, 27-53, 81-86, 98-105, 126-135, 170-176, 182-188, 203-217, 223-232, 246-252, 254-269, 274-280, 308-314 | D: 9 | aa11-53 | D: nd | 514, 565 |
| ORF0207 | Ribokinase (rbsK) | 5-11, 15-23, 47-55, 82-90, 98-103, 108-114, 126-132, 134-156, 161-186, 191-197, 210-224, 228-235, 239-248, 258-264, 275-290 | B: 10 | aa 20-45 | B: SELAQ30 (20-45): 12/12 | 241, 270 |
| ORF0288 | LrgB | 7-28, 34-56, 68-119, 127-146, 149-180, 182-189, 193-200, 211-230 | D: 4 | aa112-149 | D: nd | 515, 566 |
| ORF0304 | Herpesvirus saimiri ORF73 homolog, putative | 8-16, 30-36, 83-106, 116-122, 135-143, 152-165, 177-188, 216-225 | D: 8 | aa69-117 | D: nd | 516, 567 |
| ORF0340 | nitrate transporter | 7-21, 24-93, 101-124, 126-139, 141-156, 163-179, 187-199, 202-242, 244-261, 267-308, 313-322, 340-353, 355-376 | D: 5 | aa238-309 | D: nd | 517, 595 |
| ORF0346 | hypothetical protein | 8-27, 65-73, 87-93, 95-105 | D: 8 | aa 1-29 | D: nd | 518, 568 |
| ORF0355 | conserved hypothetical protein | 5-30, 37-43, 57-66, 85-94, 103-111, 118-125 | C: 5 | aa 63-86 | C: GSBBL39(63-86): 1/1 | 354, 360 |
| ORF0356 | conserved hypothetical protein | 4-14, 21-53, 60-146, 161-173, 175-182, 190-198, 200-211 | D: 5 | aa51-91 | D: nd | 519, 569 |
| ORF0406 | hypothetical protein | 12-32, 35-63, 68-102, 106-137, 139-145, 154-168, 173-185, 203-222, 230-259, 357-364, 366-374 | D: 19 | aa1-48, aa69-102 | D: nd | 520, 570 |
| ORF0425 | amino acid permease | 40-58, 75-86, 93-110, 117-144, 150-173, 199-219, 229-260, 264-300, 317-323, 329-356, 360-374, 377-390, 392-398, 408-424, 427-452 | D: 3 | aa401-440 | D: nd | 521, 571 |
| ORF0442 | SceB precursor | 7-22, 42-48, 55-66, 83-90, 109-118, 136-141 | C: 38 | aa 60-102 | C: GSBBM60(65-84): 1/1 | 355, 361 |
| ORF0448 | SsaA precursor | 6-25, 39-47, 120-125, 127-135, 140-148, 157-168, 200-208, 210-220, 236-243, 245-254 | C: 170 | aa 15-208 | C: GSBBN58(81-105): 1/1 C: GSBBL13(167-184): 1/1 C: GSBBL25(22-45): 1/1 | 356, 362 |
| ORF0503 | Ribosomal protein L2 | 31-39, 48-54, 61-67, 75-83, 90-98, 103-115, 123-145, 160-167, 169-176, 182-193, 195-206, 267-273 | A: 1, B: 3 | aa 212-273 | B: SELAA47(238-259): 12/12 | 242, 271 |
| ORF0551 | Conserved hypothetical protein | 5-25, 29-36, 45-53, 62-67, 73-82, 84-91, 99-105, 121-142, 161-177, 187-193, 203-224, 242-251, 266-271, 278-285 | A: 16, B: 9 | aa 162-213 | B: SELAL12(164-197): 8/12 | 243, 272 |
| ORF0556 | hypothetical protein | 4-24, 30-41, 43-68, 82-90, 107-114, 123-143, 155-168 | D: 3 | aa 1-26 | D: nd | 522, 596 |
| ORF0623 | Fumble, putative | 10-17, 32-38, 55-72, 77-84, 88-96, 126-134, 152-160, 176-185, 190-203, 208-214, 217-225, 233-252, 257-262 | A: 10, B: 12; C: 1 | aa 95-150 | B: SELAB86(95-128): 3/12 | 244, 273 |
| ORF0740 | Hypothetical protein | 18-24, 47-61, 69-83, 90-96, 125-132, 140-163, 171-188, 222-249, 281-296, 305-315, 322-330, 335-351, 354-368, 390-397, 411-422, 424-431, 451-469, 479-485, 501-507, | B: 3 | aa 1093-1114 | B: SELAB23(1097-1114): 7/12 | 245, 274 |

TABLE 2c-continued

Immunogenic proteins identified by bacterial surface and ribosome display: *S. epidermidis*.

| S. epidermidis antigenic protein | Putative function (by homology) | predicted immunogenic aa** | No. of selected clones per ORF and screen | Location of identified immunogenic region | Serum reactivity with relevant region (positive/total) | Seq ID no: (DNA + Prot) |
|---|---|---|---|---|---|---|
| | | 517-524, 539-550, 560-568, 588-599, 619-627, 662-673, 678-689, 735-742, 744-749, 780-786, 797-814, 821-827, 839-847, 857-863, 866-876, 902-911, 919-924, 967-982, 1005-1015, 1020-1026, 1062-1070, 1078-1090, 1125-1131, 1145-1150, 1164-1182, 1208-1213, 1215-1234, 1239-1251, 1256-1270, 1298-1303, 1316-1325, 1339-1349, 1362-1369, 1373-1384, 1418-1427, 1440-1448, 1468-1475, 1523-1532, 1536-1542, 1566-1573, 1575-1593, 1603-1619, 1626-1636, 1657-1667, 1679-1687, 1692-1703, 1711-1718, 1740-1746, 1749-1757, 1760-1769, 1815-1849, 1884-1890, 1905-1914, 1919-1925, 1937-1947, 1955-1963, 1970-1978, 2003-2032, 2075-2089, 2117-2124, 2133-2140, 2146-2151, 2161-2167, 2173-2179, 2184-2196, 2204-2220, 2244-2254, 2259-2264, 2285-2296, 2300-2318, 2328-2334, 2347-2354, 2381-2388, 2396-2408, 2419-2446, 2481-2486, 2493-2500, 2506-2516, 2533-2540, 2555-2567, 2576-2592, 2599-2606, 2615-2639, 2647-2655 | | | | |
| ORF0757 | hypothetical protein | 13-20, 22-28, 33-40, 60-76, 79-86, 90-102, 112-122, 129-147, 157-170, 178-185, 188-193, 200-205, 218-228, 234-240, 243-250, 265-273, 285-291, 310-316, 330-348, 361-380, 399-405, 427-446, 453-464 | C: 6 | aa 260-284 | C: GSBBN01(260-284): 1/1 | 357, 363 |
| ORF0912 | DNA mismatch repair protein | 9-16, 28-39, 47-56, 69-76, 104-121, 124-130, 137-144, 185-195, 199-214, 238-243, 293-307, 317-337, 351-370, 385-390, 411-428, 472-488, 498-516, 518-525, 528-535, 538-545, 553-559, 563-568, 579-588, 592-607, 615-622, 632-638, 641-648, 658-674, 676-705, 709-720, 727-739, 742-750, 753-760, 768-773, 783-788, 811-819, 827-838 | A: 25 | aa 242-304 | SEFAT31(242-290): n.d. | 441, 442 |
| ORF0923 | GTP-binding protein | 4-10, 18-27, 42-55, 64-72, 77-92, 114-126, 132-157, 186-196, 206-217, 236-243, 257-280, 287-300, 306-312, 321-328, 338-351, 360-367, 371-382, 385-399 | B: 13 | aa 144-163 | B: SELAD55(151-163): 8/12 | 246, 275 |
| ORF0979 | Conserved hypothetical protein | 4-28, 44-51, 53-84, 88-107, 113-192 | A: 9, B: 18 | aa 12-51 | B: SELAH01(26-49): 5/12 | 247, 276 |
| ORF0982 | sodium/alanine symporter(alsT) | 13-21, 24-50, 73-84, 91-118, 126-133, 142-149, 156-175, 189-249, 251-273, 294-332, 339-347, 358-381, 393-413, 425-448, 458-463 | D: 3 | aa277-305 | D: nd | 523, 572 |
| ORF1230 | Signal peptidase I | 6-33, 44-59, 61-69, 74-82, 92-98, 133-146, 163-175 | D: 14 | aa 1-53 | D: nd | 524, 573 |
| ORF1232 | Exonuclease RexA | 4-12, 16-32, 36-48, 50-65, 97-127, 136-142, 144-165, 176-190, 196-202, 211-222, 231-238, 245-251, 268-274, 280-286, 305-316, 334-356, 368-376, 395-402, 410-417, 426-440, 443-449, 474-486, 499-508, 510-525, 540-549, 568-576, 608-617, 624-639, 646-661, 672-678, 688-703, 706-717, 727-734, 743-755, 767-773, 783-797, 806-814, 830-839, 853-859, 863-871, 877-895, 899-918, 935-948, 976-990, | B: 6 | aa 188-219 | B: SELAA13(188-216): n.d. | 443, 444 |

TABLE 2c-continued

Immunogenic proteins identified by bacterial surface and ribosome display: *S. epidermidis*.

| S. epidermidis antigenic protein | Putative function (by homology) | predicted immunogenic aa** | No. of selected clones per ORF and screen | Location of identified immuno- genic region | Serum reactivity with relevant region (positive/total) | Seq ID no: (DNA + Prot) |
|---|---|---|---|---|---|---|
| ORF1284 | permease PerM, putative | 998-1007, 1020-1030, 1050-1062, 1070-1077, 1111-1125, 1137-1149, 1153-1160, 1195-1211 10-60, 72-96, 103-109, 127-133, 146-177, 182-189, 196-271, 277-289, 301-319, 323-344, 347-354 | D: 27 | aa55-106 | D: nd | 525, 574 |
| ORF1319 | 2-oxoglutarate decarboxylase (menD) | 9-31, 36-45, 59-67, 71-81, 86-94, 96-107, 111-122, 127-140, 153-168, 180-211, 218-224, 226-251, 256-270, 272-289, 299-305, 310-323, 334-341, 345-353, 358-364, 369-379, 384-390, 396-410, 417-423, 429-442, 454-464, 470-477, 497-505, 540-554 | B: 5; C: 1 | aa 400-413 | B: SELAF54(404-413): 11/12 | 248, 277 |
| ORF1326 | autolysin AtlE (lytD) | 6-25, 40-46, 75-81, 150-155, 200-205, 237-243, 288-295, 297-306, 308-320, 341-347, 356-363, 384-391, 417-429, 440-452, 465-473, 481-514, 540-546, 554-560, 565-577, 585-590, 602-609, 611-617, 625-634, 636-643, 661-668, 676-684, 718-724, 734-742, 747-754, 766-773, 775-781, 785-798, 800-807, 825-832, 840-857, 859-879, 886-892, 917-923, 950-956, 972-978, 987-1002, 1028-1035, 1049-1065, 1071-1099, 1111-1124, 1150-1172, 1185-1190, 1196-1207, 1234-1241, 1261-1271, 1276-1281, 1311-1320, 1325-1332 | B: 7; C: 5 | aa 1282-1298 | B: SELAD20(1282-1298): 10/12 | 249, 278 |
| ORF1333 | quinol oxidase polypeptide iv (ec 1.9.3.—) (quinol oxidase aa3-600, subunit qoxd) | 4-27, 33-55, 66-88 | D: 4 | aa 3-93 | D: nd | 526, 575 |
| ORF1356 | hypothetical protein | 9-36, 44-67, 74-97, 99-149, 161-181, 189-198, 211-224, 245-253, 267-273, 285-290, 303-324, 342-394, 396-427 | D: 32 | aa54-95 | D: nd | 527, 597 |
| ORF1373 | dihydrolipoamide acetyltransferase | 33-39, 42-78, 103-109, 126-136, 184-191, 225-232, 258-279, 287-294, 306-315, 329-334, 362-379, 381-404, 425-430 | A: 3, B: 1 | aa 124-188 | A: SEFAP57(124-188): 2/12 | 250, 279 |
| ORF1381 | hypothetical protein | 21-45, 62-67, 74-106, 108-142, 154-160, 230-236, 245-251, 298-305 | D: 5 | aa7-44 | D: nd | 528, 576 |
| ORF1420 | Muts2 protein, putative | 8-32, 34-41, 46-55, 70-76, 81-89, 97-115, 140-148, 153-159, 165-171, 175-188, 207-239, 256-276, 280-289, 297-319, 321-335, 341-347, 352-360, 364-371, 384-411, 420-440, 449-460, 495-502, 505-516, 560-566, 573-588, 598-605, 607-614, 616-624, 674-694, 702-717 | B: 7 | aa 581-608 | B: SELAM40(581-604): 9/12 | 251, 280 |
| ORF1443 | cell division protein (divIB) | 61-66, 111-117, 148-155, 173-182, 194-224, 263-293, 297-303, 313-321, 334-343, 345-356, 375-381, 384-395, 408-429, 448-454 | D: 4 | aa175-229 | D: nd | 529, 577 |
| ORF1500 | Cell division protein FtsY | 100-107, 154-167, 182-193, 200-206, 223-231, 233-243, 249-257, 265-273, 298-310, 326-336, 343-362, 370-384 | A: 2, B: 3 | aa 77-182 | B: SELAP37(139-162): 9/12 | 252, 281 |
| ORF1665 | amino acid ABC transporter, permease protein | 4-25, 44-55, 66-76, 82-90, 93-99, 104-109, 176-209, 227-242, 276-283, 287-328, 331-345, 347-376, 400-407, 409-416, 418-438, 441-474 | D: 5 | aa 1-52 | D: nd | 530, 578 |
| ORF1707 | putative host cell surface-exposed lipoprotein | 12-31, 40-69, 129-137, 140-151, 163-171, 195-202, 213-218 | D: 4 | aa 20-76 | D: nd | 531, 598 |

TABLE 2c-continued

Immunogenic proteins identified by bacterial surface and ribosome display: *S. epidermidis*.

| *S. epidermidis* antigenic protein | Putative function (by homology) | predicted immunogenic aa** | No. of selected clones per ORF and screen | Location of identified immunogenic region | Serum reactivity with relevant region (positive/total) | Seq ID no: (DNA + Prot) |
|---|---|---|---|---|---|---|
| ORF1786 | D-3-phosphoglycerate dehydrogenase, putative | 4-10, 16-32, 45-55, 66-78, 87-95, 103-115, 118-124, 135-150, 154-161, 166-174, 182-193, 197-207, 225-231, 252-261, 266-304, 310-315, 339-347, 351-359, 387-402, 411-423, 429-436, 439-450, 454-464, 498-505, 508-515 | D: 5 | aa400-442 | D: nd | 532, 579 |
| ORF1849 | yhjN protein | 8-51, 53-69, 73-79, 85-132, 139-146, 148-167, 179-205, 212-224, 231-257, 264-293, 298-304, 309-317, 322-351 | D: 5 | aa254-301 | D: nd | 533, 580 |
| ORF1877 | protein-export membrane protein SecD (secD-1) | 6-19, 26-39, 41-51, 59-67, 72-85, 91-98, 104-111, 120-126, 147-153, 158-164, 171-178, 199-209, 211-218, 233-249, 251-257, 269-329, 362-368, 370-385, 392-420, 424-432, 454-489, 506-523, 534-539, 550-556, 563-573, 576-596, 603-642, 644-651, 655-666, 685-704, 706-733, 747-753 | D: 7 | aa367-409 | D: nd | 534, 581 |
| ORF1912 | unknown conserved protein (conserved) | 23-35, 37-70, 75-84, 90-112, 129-135, 137-151, 155-180, 183-209, 211-217, 219-225, 230-248, 250-269, 274-284, 289-320, 325-353, 357-371, 374-380, 384-399, 401-411, | D: 4 | aa131-187 | D: nd | 535, 582 |
| ORF2015 | Trehalose-6-phosphate hydrolase | 8-17, 30-54, 82-89, 94-103, 157-166, 178-183, 196-204, 212-219, 222-227, 282-289, 297-307, 345-364, 380-393, 399-405, 434-439, 443-449, 453-475, 486-492, 498-507, 512-535, 538-548 | A: 3, B: 8 | aa 465-498 | B: SELAH62(465-498): 5/12 | 253, 282 |
| ORF2018 | Glucose-6-phosphate 1-DH | 4-16, 21-27, 39-51, 60-69, 76-83, 97-118, 126-132, 159-167, 171-177, 192-204, 226-240, 247-259, 281-286, 294-305, 314-320, 330-338, 353-361, 367-372, 382-392, 401-413, 427-434, 441-447, 457-463 | B: 17 | aa 250-287 | B: SELAI19(250-279): 3/12 | 254, 283 |
| ORF2040 | LysM domain protein protein | 51-56, 98-108, 128-135, 138-144, 152-158, 177-192, 217-222, 232-251, 283-305, 406-431, 433-439 | D: 23 | aa259-331 | D: nd | 536, 583 |
| ORF2098 | PilB related protein | 13-18, 36-43, 45-50, 73-79, 95-100, 111-126, 133-139 | A: 60 | aa 1-57 | A: SEFAQ50(15-57): 5/12 | 255, 284 |
| ORF2139 | sodium:sulfate symporter family protein, putative | 7-12, 22-97, 105-112, 121-128, 130-146, 152-164, 169-189, 192-203, 211-230, 238-246, 260-281, 304-309, 313-325, 327-357, 367-386, 398-444, 447-476, 491-512 | D: 41 | aa42-118 | D: nd | 537, 584 |
| ORF2172 | SceB precursor (lytE) | 4-23, 28-34, 38-43, 45-51, 63-71, 85-96, 98-112, 118-126, 167-174, 179-185, 219-228, 234-239, 256-263 | A: 438, B: 40, D: 4 | aa 6-215 | B: SELAH53(188-209): 3/12 | 256, 285 |
| ORF2200 | zinc ABC transporter, permease protein, putative | 4-31, 33-40, 48-64, 66-82, 92-114, 118-133, 137-159, 173-246, 248-266 | D: 19 | aa162-225 | D: nd | 538, 585 |
| ORF2248 | membrane protein, MmpL family, putative | 4-11, 17-34, 72-78, 127-137, 178-227, 229-255, 262-334, 352-380, 397-405, 413-419, 447-454, 462-467, 478-490, 503-509, 517-558, 560-568, 571-576, 582-609, 623-629, 631-654, 659-710, 741-746, 762-767, 771-777, 788-793, 856-867 | D: 17 | aa1-59, aa159-225, aa634-674 | D: nd | 539, 586 |
| ORF2260 | Unknown conserved protein in others | 5-10, 18-29, 31-37, 66-178, 196-204, 206-213 | B: 4 | aa 123-142 | B: SELAG77(123-142): 12/12 | 257, 286 |
| ORF2282 | conserved hypothetical protein | 16-22, 41-50, 52-64, 66-74, 89-95, 107-114, 123-130, 135-159, 167-181, 193-199, 223-231, 249-264, 279-289 | A: 4 | aa 51-97 | A: SEFAR88(51-97): 3/12 | 258, 287 |

TABLE 2c-continued

Immunogenic proteins identified by bacterial surface and ribosome display: *S. epidermidis*.

| S. epidermidis antigenic protein | Putative function (by homology) | predicted immunogenic aa** | No. of selected clones per ORF and screen | Location of identified immunogenic region | Serum reactivity with relevant region (positive/total) | Seq ID no: (DNA + Prot) |
|---|---|---|---|---|---|---|
| ORF2376 | DivIC homolog, putative | 27-56, 102-107, 111-116 | D: 7 | aa15-58 | D: nd | 540, 587 |
| ORF2439 | membrane-bound lytic murein transglycosidase D, putative | 4-9, 11-26, 36-56, 59-73, 83-100, 116-130, 148-163, 179-193, 264-270, 277-287, 311-321 | A: 459, B: 2, D: 53 | aa 10-217 | B: SELAC31(75-129): 12/12 | 259, 288 |
| ORF2493 | conserved hypothetical protein | 4-29, 37-77, 80-119 | D: 6 | aa69-113 | D: nd | 541, 588 |
| ORF2535 | ATP-binding cassette transporter-like protein, putative | 5-28, 71-81, 101-107, 128-135, 146-52, 178-188, 209-214, 224-233, 279-294, 300-306, 318-325, 342-347, 351-357 | D: 8 | aa1-65 | D: nd | 542, 589 |
| ORF2627 | cation-transporting ATPase, E1-E2 family, putative | 8-31, 34-80, 125-132, 143-153, 159-165, 176-189, 193-198, 200-206, 215-242, 244-262, 264-273, 281-289, 292-304, 318-325, 327-338, 347-371, 404-416, 422-429, 432-450, 480-488, 503-508, 517-525, 539-544, 551-562, 574-587, 600-631, 645-670 | D: 3 | aa61-105 | D: nd | 543, 590 |
| ORF2635 | Hypothetical protein | 4-10, 17-24, 26-42, 61-71, 90-96, 102-111, 117-125, 158-164, 173-182, 193-201, 241-255, 268-283, 289-298, 305-319, 340-353, 360-376, 384-390, 394-406 | A: 2, B: 2 | aa 139-169 | B: SELAB63(138-163): 7/12 | 260, 289 |
| ORF2669 | Hypothetical protein | 4-21, 35-42, 85-90, 99-105, 120-125, 148-155, 175-185, 190-196, 205-210, 217-225 | A: 14, B: 8 | aa 22-81 | B: SELAE27(22-51): 5/12 | 261, 290 |
| ORF2671 | Hypothetical protein | 4-23, 43-49, 73-84, 93-98, 107-113, 156-163, 179-190, 197-204, 208-218, 225-231, 248-255 | A: 44, B: 14 | aa 23-68 | B: SELAD21(36-61): 5/12 | 262, 291 |
| ORF2673 | Hypothetical protein | 4-20, 65-71, 99-105, 148-155, 171-182, 190-196, 204-210, 221-228, 240-246 | A: 16, B: 3 | aa 23-68 | B: SELAE25(23-54): 2/12 | 263, 292 |
| ORF2694 | Hypothetical protein | 4-26, 93-98, 121-132, 156-163, 179-192, 198-204, 212-220, 225-238 | A: 19, B: 30 | aa 25-82 | B: SELAB26(27-60): 5/12 | 264, 293 |
| ORF2695 | Hypothetical protein | 4-26, 43-50, 93-98, 107-113, 156-163, 179-190, 198-204, 212-218, 225-231, 247-254 | A: 7 | aa 22-78 | A: SEFAH77(22-66): 6/12 | 265, 294 |
| ORF2719 | two-component sensor histidine kinase, putative | 5-52, 60-71, 75-84, 91-109, 127-135, 141-156, 163-177, 185-193, 201-214, 222-243, 256-262, 270-279, 287-293, 298-303, 321-328, 334-384, 390-404, 411-418, 427-435, 438-448, 453-479, 481-498, 503-509 | B: 4 | aa 123-132 | B: SELAA62(123-132): 6/12 | 266, 295 |
| ORF2728 | Accumulation-associated protein | 4-13, 36-44, 76-86, 122-141, 164-172, 204-214, 235-242, 250-269, 291-299, 331-337, 362-369, 377-396, 419-427, 459-469, 505-524, 547-555, 587-597, 618-625, 633-652, 675-683, 715-727, 740-753, 761-780, 803-811, 842-853, 962-968, 1006-1020 | A: 265, B: 448; C: 4, D: 9 | aa 803-1001 | B: SELAA10(850-878): 11/12 | 267, 296 |
| ORF2740 | lipase precursor | 4-21, 190-200, 218-228, 233-241, 243-261, 276-297, 303-312, 316-325, 346-352, 381-387, 436-442, 457-462, 495-505, 518-532, 543-557, 574-593 | C: 3 | aa 110-177 | C: GSBBL80(110-177): 1/1 | 358, 364 |
| ORF2764 | oligopeptide ABC transporter, permease protein, putative | 14-36, 62-131, 137-147, 149-162, 164-174, 181-207, 212-222, 248-268, 279-285 | D: 4 | aa 6-41 | D: nd | 544, 591 |
| ORF2767 | unknown conserved protein in others | 7-20, 22-35, 40-50, 52-61, 63-92, 94-101, 103-126, 129-155, 161-178, 192-198, 200-208, 210-229, 232-241, 246-273, 279-332, 338-359, 369-383 | D: 4 | aa276-316 | D: nd | 545, 592 |

TABLE 2c-continued

Immunogenic proteins identified by bacterial surface and ribosome display: *S. epidermidis*.

| S. epidermidis antigenic protein | Putative function (by homology) | predicted immunogenic aa** | No. of selected clones per ORF and screen | Location of identified immunogenic region | Serum reactivity with relevant region (positive/total) | Seq ID no: (DNA + Prot) |
|---|---|---|---|---|---|---|
| ORF2809 | sodium:sulfate symporter family protein | 4-29, 37-53, 56-82, 87-100, 108-117, 121-138, 140-149, 150-160, 175-180, 189-195, 202-214, 220-247, 269-315, 324-337, 341-355, 361-412, 414-423, 425-440, 447-467 | D: 9 | aa266-317, aa357-401 | D: nd | 546, 593 |
| ORF2851 | putative transmembrane efflux protein | 7-13, 20-32, 37-90, 93-103, 107-126, 129-155, 159-173, 178-189, 195-221, 234-247, 249-255, 268-303, 308-379 | D: 11 | aa137-185 | D: nd | 547, 594 |

Bacterial surface display: A, LSE150 library in fhuA with patient sera 2 (957); B, LSE70 library in lamB with patient sera 2 (1420); C, LSE70 library in lamB with patient sera 1 (551).
Ribosome display: D, LSE150 in pMAL4.31 with P2 (1235).
**prediction of antigenic sequences longer than 5 amino acids was performed with the programme ANTIGENIC (Kolaskar and Tongaonkar, 1990). ORF, open reading frame; ARF, alternative reading frame; CRF, reading frame on complementary strand. ORF, open reading frame; CRF, reading frame on complementary strand.

TABLE 2d

Immunogenic proteins identified by bacterial surface and ribosome display: *S. aureus* (new annotation)

| S. aureus antigenic protein | Old ORF number | Putative function (by homology) | predicted immunogenic aa** | No. of selected clones per ORF and screen | Location of Identified immunogenic region | Serum reactivity with relevant region (positive/total) | Seq ID no: (DNA + Prot) |
|---|---|---|---|---|---|---|---|
| SaA0003 | ORF2967 & ORF2963 | repC | 7-19, 46-57, 85-91, 110-117, 125-133, 140-149, 156-163, 198-204, 236-251, 269-275, 283-290, 318-323, 347-363 | B: 3, C: 14; F: 29 | aa 9-42 aa 156-241 aa 300-314 aa 343-420 | C: GSBYI53(9-42): 1/1 C: GSBYG39(156-241): 1/1 C: GSBYM94(343-420): 26/30 | 394, 396 |
| ORF0123 | ORF1909 - 18 aa at N-terminus | unknown | 4-10, 25-30, 38-57, 91-108, 110-123, 125-144, 146-177, 179-198, 216-224, 226-233 | B: 3, E: 7, G: 1 | aa 145-163 | B: GSBXF80(150-163): 5/27 E: GSBZC17(150-163): 25/41 | 409, 410 |
| ORF0160 | ORF1941 - 16 aa at N-terminus | unknown | 4-26, 34-70, 72-82, 86-155, 160-166, 173-205, 207-228, 230-252, 260-268, 280-313 | A: 1 | aa 96-172 | A: GSBXO07(96-172): 5/30 | 411, 412 |
| ORF0657 | ORF unknown | LPXTGVI protein | 9-33, 56-62, 75-84, 99-105, 122-127, 163-180, 186-192, 206-228, 233-240, 254-262, 275-283, 289-296, 322-330, 348-355, 416-424, 426-438, 441-452, 484-491, 541-549, 563-569, 578-584, 624-641 | A: 2, B: 27, F: 15 | aa 526-544 | B: GSBXE07-bdb1(527-542): 11/71 F: SALAX70(526-544): 11/41 | 413, 414 |
| ORF1050 | ORF1307 - 4 aa at N-terminus | unknown | 45-68, 72-79, 91-101, 131-142, 144-160, 179-201 | A: 1, H: 45 | aa 53-124 | A: GSBXM26(53-124): 7/30 | 415, 416 |
| ORF1344 | ORF0212 - 10 aa at N-terminus | NifS protein homolog | 13-26, 40-49, 61-68, 92-112, 114-123, 138-152, 154-183, 194-200, 207-225, 229-240, 259-265, 271-284, 289-309, 319-324, 330-336, 346-352, 363-372 | A: 11 | aa 24-84 | A: GSBXK59-bmd21(24-84): 6/29 | 417, 418 |
| ORF1632 | ORF1163 - 4 aa at N-terminus | SdrH homolog | 4-31, 50-55, 243-257, 259-268, 298-316, 326-335, 364-370, 378-407 | B: 6, E: 11, F: 34 | aa 101-115 aa 115-139 aa 158-186 | B: GSDXG53(164-182): 39/71 F: SALAP07(101-115): 11/41 | 419, 420 |
| ORF2180 | ORF0594 - 2 aa at N-terminus | LPXTGIV protein | 9-17, 24-45, 67-73, 82-90, 100-107, 117-134, 137-145, 158-168, 176-183, 188-194, 206-213, 223-231, 243-248, 263-270, 275-282, 298-304, 344-355, 371-377, 382-388, 427-433, 469-479, 500-505, 534-559, 597-607, 662-687, 790-815, 918-943, 1032-1037, 1046-1060, 1104-1112, 1128-1137, 1179-1184, 1197-1204, 1209-1214, 1221-1239 | A: 3, C: 3, E: 6, F: 2, H: 6 | aa 491-587 aa 633-715 aa 702-757# aa 758-830 (aa 830-885)# | A: GSBXS61(491-555): 1/1 A: GSBXL64(494-585): 1/1 A: GSBXS92(758-841): 1/1 A: bmd4(702-757): 16/30# (A: bmd4(830-885): 16/30)# F: SALBC43(519-533): 4/41 | 421, 422 |

TABLE 2d-continued

Immunogenic proteins identified by bacterial surface and ribosome display: *S. aureus* (new annotation)

| S. aureus antigenic protein | Old ORF number | Putative function (by homology) | predicted immunogenic aa** | No. of selected clones per ORF and screen | Location of Identified immunogenic region | Serum reactivity with relevant region (positive/total) | Seq ID no: (DNA + Prot) |
|---|---|---|---|---|---|---|---|
| ORF2184 | ORF0590 - 8 aa at N-terminus | FnbpB | 10-29, 96-116, 131-137, 146-158, 167-173, 177-182, 185-191, 195-201, 227-236, 260-266, 270-284, 291-299, 301-312, 348-356, 367-376 382-396, 422-432, 442-453, 480-487, 497-503, 519-527, 543-548, 559-565, 579-585, 591-601, 616-623, 643-648, 657-663, 706-718 746-758, 791-796, 810-817, 819-825, 833-839, 847-853, 868-885, 887-895, 919-932 | A: 2, C: 4, G: 9 | aa 694-769 aa 774-847 | A: GSBXM62(694-769): 28/28 A: GSBXR22(774-847): 1/1 | 423, 424 |
| ORF2470 | ORF0299 - 14 aa at N-terminus | Conserved hypothetical protein | 4-27, 36-42, 49-55, 68-73, 94-101, 131-137, 193-200, 230-235, 270-276, 294-302, 309-324, 334-344, 347-364, 396-405, 431-437, 498-508, 513-519, 526-532, 539-544, 547-561, 587-594, 618-630, 642-653, 687-699, 713-719, 752-766 | C: 3 | aa 400-441 | C: GSBYH60(400-441): 28/31 | 425, 426 |
| ORF2498 | ORF0267 ORF app. 580 aa longer at N terminus; plus other changes | Conserved hypothetical protein | 8-19, 21-44, 63-76, 86-92, 281-286, 303-322, 327-338, 344-354, 364-373, 379-394, 405-412, 453-460, 501-506, 512-518, 526-542, 560-570, 577-583, 585-604, 622-630, 645-673, 677-691, 702-715, 727-741, 748-753, 770-785, 789-796, 851-858, 863-869, 876-881, 898-913, 917-924, 979-986, 991-997, 1004-1009, 1026-1041, 1045-1052, 1107-1114, 1119-1125, 1132-1137, 1154-1169, 1173-1192, 1198-1204, 1240-1254, 1267-1274, 1290-1298, 1612-1627 | D: 12, F: 6 | aa 358-411 aa 588-606 aa 895-909 | D: 17/21 F: SALAT38(895-909): 8/41 | 427, 428 |
| ORF2548 | ORF2711 - 12 aa at N-terminus | IgG binding protein A | 4-37, 44-53, 65-71, 75-82, 105-112, 126-132, 136-143, 164-170, 184-190, 194-201, 222-232, 242-248, 252-259, 280-291, 300-317, 413-420, 452-460, 485-503 | A: 55, B: 54, C: 35, F: 59, G: 56, H: 38 | aa 1-123 aa 207-273 aa 310-410 | A: GSBXK68(1-73): 21/30 A: GSBXK41(35-123): 1/1 A: GSBXN38(207-273): 19/30 A: GSBXL11(310-363): 10/30 B: GSBXB22(394-406): 37/71 F: SALAM17(394-406): 29/41 | 429, 430 |
| ORF2746 | ORF2507 - 3 aa at N-terminus | homology with ORF1 | 4-9, 12-17, 40-46, 91-103, 106-113, 116-125, 150-160, 172-177, 182-188, 195-206, 241-261, 263-270, 277-285, 287-294 | A: 1, H: 13 | aa 63-126 | A: GSBXO40(66-123): 8/29 | 431, 432 |
| ORF2797 | ORF2470 - 24 aa at N-terminus | unknown | 13-32, 40-75, 82-95, 97-112, 115-121, 124-154, 166-192, 201-225, 227-252, 268-273, 288-297, 308-375, 379-434 | B: 3, E: 2, F: 13, H: 3 | aa 159-176 aa 325-339 | B: GSBXE85(159-176): 11/27 F: SAIAQ47(159-176): 8/41 | 433, 434 |
| ORF2960 | ORF2298 - 5 aa at N-terminus | putative Exotoxin | 8-31, 35-44, 106-113, 129-135, 154-159, 168-178, 203-215, 227-236, 240-249, 257-266, 275-281, 290-296, 298-305, 314-319, 327-334 | C: 101, E: 2, H: 58 | aa 1-80 aa 48-121 aa 98-190 | C: GSBYG32(1-80):: 6/7 C: GSBYG61-bhe2(48-116): 26/30 C: GSBYN80(98-190): 13/17 | 435, 436 |
| ORF2963 | ORF2295 - 5 aa at N-terminus | putative Exotoxin | 8-23, 35-41, 64-70, 81-87, 109-115, 121-132, 150-167, 177-188, 194-201, 208-216, 227-233, 238-248, 265-271, 279-285 | C: 3, E: 3, G: 1 | aa 17-95 | C: GSBYJ58(17-95): 9/15 | 437, 438 |
| ORF3200 | ORF1331 +8506 aa at N-terminus | putative extracellular matrix binding protein | 8-32, 45-52, 92-103, 154-159, 162-168, 207-214, 232-248, 274-280, 297-303, 343-349, 362-375, 425-442, 477-487, 493-498, 505-512, 522-533, 543-550, 558-564, 568-574, 580-600, 618-630, 647-652, 658-672, 692-705, 711-727, 765-771, 788-798, 812-836, 847-858, 870-898, 903-910, 1005-1015, 1018-1025, 1028-1036, 1058-1069, 1075-1080, 1095-1109, 1111-1117, 1119-1133, 1166-1172, 1183-1194, 1200-1205, 1215-1222, 1248-1254, 1274-1280, 1307-1317, 1334-1340, 1381-1391, 1414-1420, 1429-1439, 1445-1467, 1478-1495, 1499-1505, | A: 11, B: 11, C: 36, H: 32 | aa 8543-8601 aa 8461-8475 | A: GSBXL07(8543-8601): 6/28 | 439, 440 |

TABLE 2d-continued

Immunogenic proteins identified by bacterial surface and ribosome display: *S. aureus* (new annotation)

| S. aureus antigenic protein | Old ORF number | Putative function (by homology) | predicted immunogenic aa** | No. of selected clones per ORF and screen | Location of Identified immunogenic region | Serum reactivity with relevant region (positive/total) | Seq ID no: (DNA + Prot) |
|---|---|---|---|---|---|---|---|
| | | | 1519-1528, 1538-1550, 1557-1562, 1572-1583, 1593-1599, 1654-1662, 1668-1692, 1701-1707, 1718-1724, 1738-1746, 1757-1783, 1786-1793, 1806-1812, 1815-1829, 1838-1848, 1853-1860, 1875-1881, 1887-1893, 1899-1908, 1933-1940, 1952-1961, 1964-1970, 1977-1983, 1990-1996, 2011-2018, 2025-2038, 2086-2101, 2103-2117, 2177-2191, 2195-2213, 2220-2225, 4"2237-2249, 2273-2279, 2298-2305, 2319-2327, 2349-2354, 2375-2381, 2391-2398, 2426-2433, 2436-2444, 2449-2454, 2463-2469, 2493-2499, 2574-2589, 2593-2599, 2605-2611, 2615-2624, 2670-2684, 2687-2698, 2720-2727, 2734-2754, 2762-2774, 2846-2866, 2903-2923, 2950-2956, 2985-2998, 3011-3031, 3057-3064, 2"3102-3117, 3137-3143, 3186-3195, 3211-3219, 3255-3270, 3290-3300, 3327-3334, 3337-3343, 3390-3396, 3412-3419, 3439-3446, 3465-3470, 3492-3500, 3504-3510, 3565-3573, 3642-3650, 3691-3698, 3766-3775, 3777-3788, 3822-3828, 3837-3847, 3859-3864, 3868-3879, 3895-3902, 3943-3951, 3963-3971, 3991-3997, 4018-4030, 4054-4060, 4074-4099, 4123-4129, 4147-4153, 4195-4201, 4250-4255, 4262-4267, 4270-4277, 4303-4310, 4321-4330, 4343-4352, 4396-4408, 4446-4451, 4471-4481, 4503-4509, 4516-4534, 4596-4604, 4638-4658, 4698-4710, 4719-4732, 4776-4783, 4825-4833, 4851-4862, 4882-4888, 4894-4909, 4937-4942, 5047-5054, 5094-5100, 5102-5112, 5120-5125, 5146-5153, 5155-5164, 5203-5214, 5226-5236, 5278-5284, 5315-5321, 5328-5342, 5348-5359, 5410-5420, 5454-5466, 5481-5489, 5522-5538, 5597-5602, 5607-5614, 0"5623-5629, 5650-5665, 5707-5719, 5734-5742, 5772-5778, 5785-5790, 5833-5845, 5857-5863, 5899-5904, 5908-5921, 5959-5971, 5981-5989, 6010-6017, 6034-6043, 6058-6064, 6112-6120, 6154-6169, 6210-6217, 6231-6240, 6261-6268, 6288-6294, 6318-6324, 6340-6349, 6358-6369, 6402-6407, 6433-6438, 6483-6493, 6513-6519, 6527-6546, 6561-6574, 6599-6608, 6610-6616, 6662-6673, 6696-6705, 6729-6743, 6769-6775, 6792-6801, 6819-6828, 6840-6846, 6860-6870, 6915-6928, 6966-6972, 7021-7028, 7032-7047, 7096-7101, 7109-7117, 7138-7149, 7157-7162, 7201-7206, 7238-7253, 7283-7294, 7296-7302, 7344-7365, 7367-7376, 7389-7404, 7413-7433, 7475-7482, 7493-7500, 7535-7549, 7596-7608, 7646-7651, 7661-7678, 7722-7731, 7741-7754, 7764-7769, 7776-7782, 7791-7806, 7825-7837, 7862-7875, 7891-7897, 7922-7931, 7974-7981, 7999-8005, 8039-8045, 8049-8065, 8070-8075, 8099-8112, 8119-8125, 8151-8158, | | | | |

TABLE 2d-continued

Immunogenic proteins identified by bacterial surface and ribosome display: *S. aureus* (new annotation)

| S. aureus antigenic protein | Old ORF number | Putative function (by homology) | predicted immunogenic aa** | No. of selected clones per ORF and screen | Location of Identified immunogenic region | Serum reactivity with relevant region (positive/total) | Seq ID no: (DNA + Prot) |
|---|---|---|---|---|---|---|---|
| | | | 8169-8181, 8226-8232, 8258-8264, 8291-8299, 8301-8310, 8325-8335, 8375-8389, 8394-8400, 8405-8412, 8421-8436, 8478-8485, 8512-8521, 8528-8538, 8564-8579, 8587-8594, 8603-8615, 8626-8637, 8640-8646, 8657-8672, 8684-8691, 8725-8736, 8748-8761, 8777-8783, 8794-8799, 8810-8825, 8851-8862, 8874-8887, 8903-8912, 8914-8926, 8933-8943, 8954-8960, 8979-8988, 9004-9011, 9035-9041, 9056-9069, 9077-9086, 9088-9096, 9106-9111, 9124-9133, 9183-9191, 9224-9231, 9235-9241, 9250-9265, 9279-9290, 9295-9300, 9326-9343, 9408-9414, 9422-9427, 9435-9441, 9455-9461, 9507-9517 9532-9538, 9580-9589, 9594-9600, 9614-9623, 9643-9648, 9665-9683, 9688-9700, 9720-9726, 9742-9758, 9767-9775, 9795-9800, 9817-9835, 9842-9847, 9912-9919, 9925-9938, 9943-9963, 9970-10009, 10025-10031, 10037-10043, 10045-10063, 10066-10073, 10117-10124, 10126-10136, 10203-10210, 10218-10225, 10232-10242, 10287-10292, 10303-10323, 10352-10360, 10385-10396, 10425-10431, 10452-10459, 10480-10485 | | | | |

Bacterial surface display: A, LSA250/1 library in fhuA with patient sera 1 (655); B, LSA50/6 library in lamB with patient sera 1 (484); C, LSA250/1 library in fhuA with IC sera 1 (571); E, LSA50/6 library in lamB with IC sera 2 (454); F, LSA50/6 library in lamB with patient sera P1 (1105); G, LSA50/6 library in lamb with IC sera 1 (471). Ribosome display: D, LSA250/1 library with IC sera (1686).
**prediction of antigenic sequences longer than 5 amino acids was performed with the programme ANTIGENIC (Kolaskar and Tongaonkar, 1990);
identical sequence present twice in ORF.

TABLE 3

Serological proteome analysis of *S. aureus* surface proteins using human sera a) *S. aureus*/agr "stress conditions"

| Spot ID/sera | IC40 1:20,000 | IC35, N26, C4 1:50,000 each | Infant pool C2, 5, 6, 10, 12 1:10,000 | N22 1:10.000 IC40 1:50,000 |
|---|---|---|---|---|
| PCK2 | + | + | − | + |
| PCK4 | + | +++ | − | +++ |
| PCK5 | − | (+) | − | + |
| PCK6 | + | + | − | + |

| Spot ID/sera | IC35, 40 1:50,000 N22 1:10,000 | P-pool (P6, 18, 25, 28, 29) 1:50,000 each | Infant pool C2, 5, 6, 10, 12 1:10,000 |
|---|---|---|---|
| PAC1 | ++ | ++ | − |
| PAC2 | ++ | +++ | − |
| PAC3 | − | + | − |
| PAC5 | − | ++ | − |

| Spot ID/sera | P-pool (P6, 18, 25, 28, 29) 1:50,000 each | Infant 14 1:10,000 | IC pool/ IgG (N26, IC34, 35) 1:30,000 each | IC pool/ IgA (N26, IC34, 35) 1:30,000 each |
|---|---|---|---|---|
| PAC11 | ++ | − | ++ | ++ |
| PAC12 | ++ | − | ++ | ++ |
| PAC13 | − | − | − | ++ |
| PAC14 | − | − | + | + |

TABLE 3-continued

Serological proteome analysis of *S. aureus* surface proteins using human sera

| PAC15 | - | - | +++ | +++ |
|---|---|---|---|---|
| PAC16 | + | - | + | + |
| PAC17 | + | - | + | + |
| PAC18 | ++ | - | - | - |
| PAC19 | - | - | ++ | ++ |
| PAC20 | ++ | - | - | - |
| POV31 | +++ | - | - | - |
| POV32 | + | - | - | - |
| POV33 | + | - | - | - |
| POV34 | + | - | - | - |
| POV35 | + | - | - | - |
| POV36 | + | - | - | - |
| POV37 | ++ | - | - | - |
| POV38 | ++ | - | - | - |
| POV39 | +++ | - | - | - |
| POV40 | +++ | - | - | - | b) *S. aureus*/COL "standard conditions"

| Spot ID/sera | IC pool (N26, IC34, 35) 1:30,000 each | IC35 1:20,000 | P18 1:10,000 | P25 1:10,000 | P1 1:5,000 | P29 1:2,500 | Infant 18 1:10,000 |
|---|---|---|---|---|---|---|---|
| POV2 | +++ | +++ | +++ | +++ | +++ | - | - |
| POV3.1 | +++ | +++ | +++ | +++ | +++ | - | - |
| POV3.2 | +++ | +++ | +++ | +++ | +++ | - | - |
| POV4 | + | +++ | - | - | - | - | - |
| POV7 | - | - | +++ | - | - | - | - |
| POV10 | - | ++ | (+) | (+) | - | (+) | - |
| POV12 | - | - | - | - | - | +++ | - |
| POV13 | ++ | +++ | +++ | +++ | ++ | ++ | - |
| POV14 | ++ | +++ | +++ | ++ | ++ | ++ | - |
| POV15 | + | + | - | + | (+) | - | - | c) *S. aureus*/COL "stress conditions"

| Spot ID/sera | P-pool (P6, 18, 25, 28, 29) 1:50,000 each | IC34 + IC35 1:20,000 each | P18 1:10,000 | P29 1:10,000 | Infant 14 1:10,000 |
|---|---|---|---|---|---|
| POV16 | - | +++ | - | - | - |
| POV17 | - | +++ | (+) | - | - |
| POV18 | + | - | ++ | - | - |
| POV19 | (+) | - | +++ | - | - |
| POV21 | - | - | + | - | - |
| POV23 | - | + | - | - | - |
| POV24 | - | + | - | - | - |
| POV25 | + | - | - | - | - |

TABLE 4

*S. aureus* antigens identified by MALDI-TOF-MS sequencing
(ORFs in bold were also identified by bacterial surface display)
Prediction of antigenic regions in selected antigens identified
by serological proteome analysis using human sera

| spot ID | *S. aureus* protein (ORF no./abbrev.) | Putative function (by homology) | Seq ID no: (DNA, Prot) | Putative localization |
|---|---|---|---|---|
| PCK2 | ORF0599 | Glycinamide-ribosyl synthase | 107, 108 | cytoplasmic |
| PCK5 | ORF0484 yitU | conserved hypoth. protein (yitU) | 109, 110 | cytoplasmic |
| PCK6 | ORF2309 mqo | membrane-associated malate-quinone oxidase | 111, 112 | peripheral membrane |
| POV2 | ORF0766 aux1 | protein phosphatase contributing to methicilin resistance | 113, 114 | trans-membrane |
| POV4, 17 PAC14, 19 | ORF0078 EF-Tu | C-terminal part of 44 kDa protein similar to elongation factor Tu | 115, 116 | cytoplasmic/ secreted |
| POV5[1)] | ORF0782 | 3-ketoacyl-acyl carrier protein reductase (fabG) | 117, 118 | cytoplasmic |
| POV7 | ORF0317 SecA | protein transport across the membrane SecA | 39, 91 | cytoplasmic |

TABLE 4-continued

*S. aureus* antigens identified by MALDI-TOF-MS sequencing
(ORFs in bold were also identified by bacterial surface display)
Prediction of antigenic regions in selected antigens identified
by serological proteome analysis using human sera

| | | | | |
|---|---|---|---|---|
| POV10 | ORF1252 yrzC | hypothetical BACSU 11.9 kd protein (upf0074 (rff2) family) | 119, 120 | cytoplasmic |
| POV12 | ORF0621 pdhB | dihydrolipoamide acetyltransferase (pdhB) | 121, 122 | cytoplasmic |
| POV14 | ORF0072 rpoB | DNA-directed RNA polymerase β | 125, 126 | cytoplasmic |
| POV15 | ORF0077 EF-G | 85 kD vitronectin binding protein | 127, 128 | cytoplasmic |
| POV18 | not found YLY1 | general stress protein YLY1 | 129, 130 | cytoplasmic |
| POV30[1)] | ORF0069 RL7 | ribosomal protein L7 | 131, 132 | cytoplasmic |
| POV21 | ORF0103 yckG | probable hexulose-6-phosphate synthase (yckG) | 133, 134 | cytoplasmic |
| ,POV24 | ORF0419 yurX | conserved hypothetical protein (yurX) | 137, 138 | cytoplasmic |
| POV25 | ORF2441 gidA | glucose inhibited division protein a (gidA) | 139, 140 | cytoplasmic |
| PAC1 | ORF1490 prsA | protein export protein prsa precursor (prsA) | 173, 174 | periplasmic |
| PAC2 | ORF1931 ModA | periplasmic molybdate binding protein (ModA) | 175, 176 | surface |
| PAC3 | ORF2053 | heavy metal dependent transcriptional activator, putative regulator of multidrug resistance efflux pump pmrA | 177, 178 | cytoplasmic |
| PAC5 | ORF2233 ydaP | pyruvate oxidase (ydaP) | 179, 180 | cytoplasmic |
| PAC11 | ORF1361 | LPXTGV, extracellularmatrix-bdg. | 3, 56 | surface |
| PAC12 | ORF1244 alaS | alanyl-tRNA synthetase | 159, 160 | cytoplasmic |
| PAC13 | ORF0835 ymfA | RNA processing enzyme/ATP-bdg. | 161, 162 | cytoplasmic |
| PAC15 | ORF1124 bfmBB | lipoamid acyltransferase component of branched-chain alpha-keto acid dehydrogenase complex | 163, 164 | cytoplasmic |
| PAC16 | ORF0340 GAPDH | glyceraldehydes-3-phosphate dehydrogenase | 165, 166 | cytoplasmic |
| PAC17 | not found ContigB3 | 5'-methylthioadenosine nucleosidase/ S-adenosylhomo-cysteine nucleosidase | | cytoplasmic |
| PAC20 | ORF2711 | 75% Identity to ORF2715 similar to hypothetical proteins | 167, 168 | unknown |
| POV31 | ORF0659 | 29 kDa surface protein | 236, 238 | surface |
| POV32 | ORF0659 | 29 kDa surface protein | 236, 238 | surface |
| POV33 | ORF0659 | 29 kDa surface protein | 236, 238 | surface |
| POV34 | ORF0659 | 29 kDa surface protein | 236, 238 | surface |
| POV35 | ORF0659 | 29 kDa surface protein | 236, 238 | surface |
| POV36 | ORF00661 | LPXTG-motif cell wall anchor domain protein | 235, 237 | surface |
| POV37 | ORF0659 | 29 kDa surface protein | 236, 238 | surface |
| POV38 | ORF0659 | 29 kDa surface protein | 236, 238 | surface |
| POV39 | ORF0657 | LPXTG-anchored surface protein | 1, 142 | surface |
| POV40 | not identified | | | |

| Seq ID no: (Protein) | spot ID | *S. aureus* ORF no./abbrev. | Putative localization | Putative antigenic surface areas (Antigenic package) |
|---|---|---|---|---|
| 112 | PCK6 | ORF2309 mqo | peripheral membrane | 61-75, 82-87, 97-104, 113-123, 128-133, 203-216, 224-229, 236-246, 251-258, 271-286, 288-294, 301-310, 316-329, 337-346, 348-371, 394-406, 418-435, 440-452 |
| 114 | POV2 | ORF766 aux1 | trans-membrane | 30-37, 44-55, 83-91, 101-118, 121-128, 136-149, 175-183, 185-193, 206-212, 222-229, 235-242 |
| 116 | POV4 | ORF078 EF-Tu | cytoplasmic/secreted | 28-38, 76-91, 102-109, 118-141, 146-153, 155-161, 165-179, 186-202, 215-221, 234-249, 262-269, 276-282, 289-302, 306-314, 321-326, 338-345, 360-369, 385-391 |
| 176 | PAC2 | ORF1931 ModA | periplasmic | 29-44, 74-83, 105-113, 119-125, 130-148, 155-175, 182-190, 198-211, 238-245 |
| 174 | PAC1 | ORF1490 prsA | periplasmic | 5-24, 38-44, 100-106, 118-130, 144-154, 204-210, 218-223, 228-243, 257-264, 266-286, 292-299 |

TABLE 4-continued

S. aureus antigens identified by MALDI-TOF-MS sequencing
(ORFs in bold were also identified by bacterial surface display)
Prediction of antigenic regions in selected antigens identified
by serological proteome analysis using human sera

| 168 | PAC20 | ORF2711 | unknown | 7-14, 21-30, 34-50, 52-63, 65-72, 77-84, 109-124, 129-152, 158-163, 175-190, 193-216, 219-234 |
|---|---|---|---|---|

| spot ID | GI no. or TIGR no. | S. aureus protein (ORF no./abbrev.) | Putative function (by homology) | Seq ID no: (DNA, Prot) |
|---|---|---|---|---|
| PCK2 | TIGR1280 | ORF0599 | Glycinamide-ribosyl synthase | 107, 108 |
| PCK4 | 7672993 | ORF2268 IsaA | possibly adhesion/aggregation | 12, 64 |
| PCK5 | TIGR6209 | ORF0484 yitU | conserved hypoth. protein (yitU) | 109, 110 |
| PCK6 | TIGR6182 | ORF2309 | membrane-associated malate-quinone oxidase | 111, 112 |
| POV2 | 6434044 | ORF0766 aux1 | protein phosphatase contributing to methicilin resistance | 113, 114 |
| POV3.1 | 7672993 | ORF2268 IsaA | possibly adhesion/aggregation | 12, 64 |
| POV3.2 | 7672993 | ORF2268 IsaA | possibly adhesion/aggregation | 12, 64 |
| POV4 | TIGR8079 | ORF0078 EF-Tu | C-terminal part of 44 kDa protein similar to elongation factor Tu | 115, 116 |
| POV5[1] | TIGR8091 | ORF0782 | 3-ketoacyl-acyl carrier protein reductase (fabG) | 117, 118 |
| POV7 | 2500720 | ORF0317 SecA | protein transport across the membrane SecA | 39, 91 |
| POV10 | TIGR8097 | ORF1252 yrzC | hypothetical BACSU 11.9 kd protein (upf0074 (rff2) family) | 119, 120 |
| POV12 | 2499415 | ORF0621 pdhB | dihydrolipoamide acetyltransferase (pdhB) | 121, 122 |
| POV13 | 7470965 | ORF0094 SdrD | fibrinogen-bdg. (LPXTG) protein homolog (SdrD) | 123, 124 |
| POV14 | 1350849 | ORF0072 rpoB | DNA-directed RNA polymerase β | 125, 126 |
| POV15 | 6920067 | ORF0077 EF-G | 85 kD vitronectin binding protein | 127, 128 |
| POV17 | TIGR8079 | ORF0078 | C-terminal part of 44 kDa protein similar to elongation factor Tu | 115, 116 |
| POV18 | 3025223 | not found | general stress protein YLY1 | 129, 130 |
| POV30[1] | 350771 | ORF0069 RL7 | ribosomal protein L7 | 131, 132 |
| POV21 | | ORF0103 | probable hexulose-6-phosphate synthase (yckG) | 133, 134 |
| POV23 | | ORF0182 | S. epidermis) | 135, 136 |

[1]identified from a total lysate from S. aureus 8325-4 spa-grown under standard conditions. Seroreactivity with 1/1 patient and 2/4 normal sera but not with infant serum (C5).

REFERENCES

Aichinger G., Karlsson L., Jackson M. R., Vestberg M., Vaughau J. H., Teyton L., Lechler R. I. and Peterson P. A. Major Histocompatibility Complex classII-dependent unfolding, transport and degradation of endogenous proteins. J. Biol. Chem., v. 272, 1997, pp. 29127-29136

Ausubel, F. M., Brent, R., Kingston, R. E., Moore, D. D., Seidman, J. G., Smith, J. A. and Struhl, K. Eds. (1994). Current protocols in molecular biology. John Wiley & Sons, Inc.

Betley, M. J., Lofdahl, S., Kreiswirth, B. N., Bergdoll, M. S. and Novick, R. P. (1984). Staphylococcal enterotoxin A gene is associated with a variable genetic element. Proc. Natl. Acad. Sci. U.S.A. 81:5179-5183.

Bruggemann M, Neuberger M S (1996) Immunol. Today 17:391-397

Burnie, J. P., Matthews, R. C., Carter, T., Beaulieu, E., Donohoe, M., Chapman, C., Williamson, P. and Hodgetts, S. J. (2000). Identification of an immunodominant ABC transporter in methicillin-resistant Staphylococcus aureus infections. Infect. Immun. 68:3200-3209.

Chen, H. Z. and Zubay, G. (1983). Methods Enzymol. 101: 674-690.

Coloque-Navarro, P., Söderquist, B., Holmherg, H., Blomqvist, L., Olcen, P., and Möllby, R. (1998) Antibody response in Staphylococcus aureus septicaemia—a prospective study. J. Med. Microbiol. 47, 217-25.

Crossley, K. B. and Archer G. L., eds. (1997). The Staphylococci in Human Disease. Churchill Livingston Inc.

Flock, J.-I. (1999). Extracellular-matrix-binding proteins as targets for the prevention of Staphylococcus aureus infections. Molecular Medicine Today 5:532-537.

Forrer, P., Jung, S. and Pluckthun, A. (1999). Beyond binding: using phage display to select for structure, folding and enzymatic activity in proteins. Curr. Opin. Struct. Biol. 9:514-520.

Foster, T. J. and Hook, M. (1998). Surface protein adhesins of Staphylococcus aureus. Trends Microbiol. 6:484-488.

Frénay, H. M. E., Theelen, J. P. G., Schouls, L. M., Vandenbroucke-Grauls, C. M. J. E., Vernoef, J., van Leeuwen, W. J., and Mooi, F. R. (1994). Discrimination of epidemic and nonepidemic methicillin-resistant Staphylococcus aureus on the basis of protein A gene polymorphism. J. Clin. Microbiol. 32:846-847.

Georgiou, G., Stathopoulos, C., Daugherty, P. S., Nayak, A. R., Iverson, B. L. and Curtiss III, R. (1997). Display of heterologous proteins on the surface of microorganisms: From the screening of combinatorial libraries to live recombinant vaccines. Nature Biotechnology 15:29-34.

Goh, S.-H., Byrne, S. K., Zhang, J. L., and Chow, A. W. (1992). Molecular typing of *Staphylococcus aureus* on the basis of coagulase gene polymorphisms. J. Clin. Microbiol. 30:1642-1645.

Graziano et al. (1995) J. Immunol. 155:4996-5002

Hammer et al. J. Exp. Med (1995) 181: 1847-1855

Hanes, J. and Plückthun, A. (1997). In vitro selection and evolution of functional proteins by using ribosome display. PNAS 94:4937-4942.

Hashemzadeh-Bonehi, L., Mehraein-Ghomi, F., Mitsopoulos, C., Jacob, J. P., Hennessey, E. S. and Broome-Smith, J. K. (1998). Importance of using lac rather than ara promoter vectors for modulating the levels of toxic gene products in *Escherichia coli*. Mol. Microbiol. 30:676-678.

Hryniewicz, W. (1999). Epidemiology of MRSA. Infection 27:S13-16.

Immler, D., Gremm, D., Kirsch, D., Spengler, B., Presek, P., Meyer, H. E. (1998). Electrophoresis 19:1015-1023.

Kajava, A. V., Zolov, S. N., Kalinin, A. E. and Nesmeyanova, M. A. (2000). The net charge of the first 18 residues of the mature sequence affects protein translocation across the cytoplasmic membrane of Gram-negative bacteria. J. Bacteriol. 182:2163-2169.

Kluytmans, J., van Belkum, A. and Verbrugh, H. (1997). Nasal carriage of *Staphylococcus aureus*: epidemiology, underlying mechanisms, and associated risks. Clin. Microbiol. Rev. 10:505-520.

Kolaskar, A. S. and Tongaonkar, P. C. (1990). A semi-empirical method for prediction of antigenic determinants on protein antigens. FEBS Lett. 276:172-174.

Lim, Y., Shin, S. H., Jang, I. Y., Rhee, J. H. and Kim, I. S. (1998). Human transferring-binding protein of *Staphylococcus aureus* is immunogenic in vivo and has an epitope in common with human transferring receptor. FEMS Microbiol. Letters 166:225-230.

Lorenz, U., Ohlsen, K., Karch, H., Hecker, M., Thiede, A. and Hacker, J. (2000). Human antibody response during sepsis against targets expressed by methicillin resistant *Staphylococcus aureus*. FEMS Immunol. Med. Microbiol. 29:145-153.

Mamo, W., Jonsson, P. and Muller, H. P. (1995). Opsonization of *Staphylococcus aureus* with a fibronectin-binding protein antiserum induces protection in mice. Microb. Pathog. 19:49-55

McGuiness B T et al. (1996) Nature Biotech. 14:1149

Modun, B., Evans, R. W., Joannou, C. L. and Williams, P. (1998). Receptor-mediated recognition and uptake of iron from human transferring by *Staphylococcus aureus* and *Staphylococcus* epidermidis. Infect. Immun. 66:3591-3596.

Nilsson, I., Patti, J. M., Bremell, T., Höök, M. and Tarkowski, A. (1998). Vaccination with a Recombinant Fragment of Collagen Adhesin provides Protection against *Staphylococcus aureus*-mediated Septic Death. J. Clin. Invest. 101: 2640-2649.

Parker, K. C., M. A. Bednarek, and J. E. Coligan (1994) Scheme for ranking potential HLA-A2 binding peptides based on independent binding of individual peptide sidechains. J. Immunol. 152:163.

Pasquali, C., Fialka, I. & Huber, L. A. (1997). Electrophoresis 18:2573-2581.

Phillips-Quagliata, J. M., Patel, S., Han, J. K.; Arakelov, S., Rao, T. D., Shulman, M. J., Fazel, S., Corley, R. B., Everett, M., Klein, M. H., Underdown, B. J. and Corthesy, B. (2000). The IgA/IgM receptor expressed on a murine B cell lymphoma is poly-Ig receptor. J. Immunol. 165:2544-2555

Rammensee, Hans-Georg, Jutta Bachmann, Niels Nikolaus Emmerich, Oskar Alexander Bachor, Stefan Stevanovic (1999) SYFPEITHI: database for MHC ligands and peptide motifs. Immunogenetics 50: 213-219

Recsei P., Kreiswirth, B., O'Reilly, M., Schlievert, P., Gruss, A. and Novick, R. P. (1986). Regulation of exoprotein gene expression in *Staphylococcus aureus* by agr. Mol. Gen. Genet. 202:58-61.

Rodi, D. J. and Makowski, L. (1999). Phage-display technology—finding a needle in a vast molecular haystack. Curr. Opin. Biotechnol. 10:87-93.

Schaffitzel et al., Ribosome display: an in vitro method for selection and evolution of antibodies from libraries; Journal of Immunological Methods 231, 119-135 (1999).

Sanchez-Campillo, M., Bini, L., Comanducci, M., Raggiaschi, R., Marzocchi, B., Pallini, V. and Ratti, G. (1999). Electrophoresis 20:2269-2279.

Schmittel A, Keilholz U, Thiel E, Scheibenbogen C. (2000) Quantification of tumor-specific T lymphocytes with the ELISPOT assay. J Immunother 23(3):289-95

Sester N, Sester U, Kohler H, Schneider T, Deml L, Wagner R, Mueller-Lantzsch N, Pees H W, Meyerhans A. (2000) Rapid whole blood analysis of virus-specific CD4 and CD8 T cell responses in persistent HIV infection. AIDS 14(17): 2653-60.

Shafer, W. M. and Iandolo, J. J. (1979). Genetics of staphylococcal enterotoxin B in methicillin-resistant isolates of *Staphylococcus aureus*. Infect. Immun. 25:902-911.

Shibuya, A., Sakamoto, N., Shimizu, Y., Shibuya, K., Osawa, M., Hiroyama, T., Eyre, H. J., Sutherland, G. R., Endo, Y., Fujita, T., Miyabayashi, T., Sakano, S., Tsuji, T., Nakayama, E., Phillips, J. H., Lanier, L. L. and Nakauchi, H. (2000). $Fc_{a/g}$ receptor mediates endocytosis of IgM-coated microbes. Nature Immunology 1:441-446.)

Skerra, A. (1994). Use of the tetracycline promoter for the tightly regulated production of a murine antibody fragment in *Escherichia coli*. Gene 151:131-135.

Sohail, M. (1998). A simple and rapid method for preparing genomic DNA from Gram-positive bacteria. Mol. Biotech. 10:191-193.

Sonderstrup G, Cope A P, Patel S, Congia M, Hain N. Hall F C, Parry S L, Fugger L H, Michie S, McDevitt H O (1999) HLA class II transgenic mice: models of the human CD4+ T-cell immune response. Immunol Rev 172:335-43

Sturniolo, T. et al., E Bono, J Ding, L Raddrizzani, O. Tuereci, U Sahin, M Braxenthaler, F Gallazzi, M P Protti, F Sinigaglia, and J Hammer (1999) Generation of tissue-specific and promiscuous HLA ligand databases using DNA chips and virtual HLA class II matrices. Nature Biotechnology 17: 555-562.

Valli et al. J. Clin. Invest. (1993) 91: 616-62

VandenBergh M. F. Q., Yzerman E. P. F., van Belkum, A., Boelens, H. A. M., Sijmons, M., and Verbrugh, H. A. (1999). Follow-up of *Staphylococcus aureus* nasal carriage after 8 years: redining the persistent carrier state. J. Clin. Microbiol. 37:3133-3140.

Wessel, D. and Fluegge, U. I. (1984). Anal. Biochem. 138: 141-143.

SEQUENCE LISTING (641 sequences)

SEQ ID NO: 1 - DNA, 1938 bp, Staphylococcus aureus
atgaacaaacagcaaaaagaatttaaatcattttattcaattagaaagtcatcactaggcgttgcatctgtagcaattagtacacttttattattaatgtcaaatggcgaagcacaagcagcagctgaagaaacaggtggtacaaatacagaagcacaaccaaaaactgaagcagttgcaagtccaacaacaacatctgaaaaagctccagaaactaaaccagtagctaatgctgtctcagtatctaataaagaagttgaggcccctacttctgaaacaaaagaagctaaagaagttaaagaagttaaagcccctaaggaaacaaaagaagttaaaccagcagcaaaagccactaacaatacatatcctattttgaatcaggaacttagagaagcgattaaaaaccctgccataaaagacaaagatcatagcgcaccaaactctcgtccaattgattttgaaatgaaaaagaaagatggaactcaacagttttatcattatgcaagttctgttaaacctgctagagttattttcactgattcaaaaccagaaattgaattaggattacaatcaggtcaattttggagaaaatttgaagtttatgaaggtgacaaaaagttgccaattaaattagtatcatacgatactgttaaagattatgcttacattcgcttctctgtatcaaacggaacaaaagctgttaaaattgttagttcaacacacttcaataacaaagaagaaaaatacgattacacattaatggaattcgcacaaccaatttataacagtgcagataaattcaaaactgaagaagattataaagctgaaaaattattagcgccatataaaaaagcgaaaacactagaaagacaagtttatgaattaaataaaattcaagataaacttcctgaaaaattaaaggctgagtacaagaagaaattagaggatacaaagaaagctttagatgagcaagtgaaatcagctattactgaattccaaaatgtacaaccaacaaatgaaaaaatgactgatttacaagatacaaaatatgttgtttatgaaagtgttgagaataacgaatctatgatggatacttttgttaaacaccctattaaaacaggtatgcttaacggcaaaaaatatatggtcatggaaactactaatgacgattactggaaagatttcatggttgaaggtcaacgtgttagaactataagcaaagatgctaaaaataatactagaacaattattttcccatatgttgaaggtaaaactctatatgatgctatcgttaaagttcacgtaaaaacgattgattatgatggacaataccatgtcagaatcgttgataaagaagcatttacaaaagccaataccgataaatctaacaaaaaagaacaacaagataactcagctaagaaggaagctactccagctacgcctagcaaaccaacaccatcacctgttgaaaaagaatcacaaaaacaagacagccaaaaagatgacaataaacaattaccaagtgttgaaaaagaaaatgacgcatctagtgagtcaggtaaaggcgtaacgcttgctacaaaaccaactaaaggtgaagtagaatcaagtagtacaactccaactaaggtagtatctacgactcaaaatgttgcaaaaccaacaactggttcatcaaaaacaacaaaagatgttgttcaaacttcagcaggttctagcgaagcaaaagatagtgctccattacaaaaagcaaacattaaacacacaaatgatggacacactcaaagccaaaacaataaaaatacacaagaaaataaagcaaaatcattaccacaaactggtgaagaatcaaataaagatatgacattaccattaatggcattattagctttaagtagcatcgttgcattcgtattacctagaaaacgtaaaaactaa

SEQ ID NO: 2 - DNA, 939 bp, Staphylococcus aureus
atgagaaatatagagaatctaaatcccggagattcagttgatcactttttcttagtgcataaagctacacagggtgtaacagcacaaggtaaagattatatgacattacatttgcaagataaaagtggtgaaattgaagcgaaattttggacggctacaaaaaatgatatggcaacaatcaagcctgaagaaattgtacatgttaaaggtgacatcataaactatcgcggaaataaacagatgaaagtcaaccaaattagactagcgacaactgaagatcaattaaaaacagaacaatttgtagatggtgcacctttatcaccggcagaaatacaagaagagatttctcattatttgctagatattgaaaatgctaatttacaacgtatcacacgtcatttattgaaaaaatatcaagaacgattttacacatatccagctgctagttctcatcatcataactttgcgagtggcttaagctatcatgtattaacgatgttacgtattgcaaaatcaatttgtgacatttatccattgttaaacaaaagtttgttatatagtggtattattttgcatgatattggtaaagttagagaattgagtggtcctgttgcgacgtcgtatacagtcgaaggtaacttattaggacacatctcgattgcgagtgatgaagtagttgaagcagctcgtgaattgaacattgaaggagaagaaatcatgttgttaagacatatgattttatctcatcatggtaagttagagtatggttctccaaaactgccatacttaaaagaagcagaaattttatgctatatcgataatatcgatgctagaatgaatatgtttgaaaaggcatataaaaaaactgacaagggtcagtttacagataaaatatttggtcttgaaaatcgtagattctacaatcctgaatcactcgat

SEQ ID NO: 3 - DNA, 2685 bp, Staphylococcus aureus
atgaacaaacatcacccaaaattaaggtctttctattctattagaaaatcaactctaggcgttgcatcggtcattgtcagtacactatttttaattacttctcaacatcaagcacaagcagcagaaaatacaaatacttcagataaaatctcggaaaatcaaaataataatgcaactacaactcagccacctaaggatacaaatcaaacacaacctgctacgcaaccagcaaacactgcgaaaaactatcctgcagcggatgaatcacttaaagatgcaattaaagatcctgcattagaaaataaagaacatgatataggtccaagagaacaagtcaatttccagttattagataaaaacaatgaaacgcagtactatcactttttcagcatcaaagatccagcagatgtgtattacactaaaaagaaagcagaagttgaattagacatcaatactgcttcaacatggaagaagtttgaagtctatgaaaacaatcaaaaattgccagtgagacttgtatcatatagtcctgtaccagaagaccatgcctatattcgattcccagtttcagatggcacacaagaattgaaaattgtttcttcgactcaaattgatgatggagaagaaacaaattatgattatactaaattagtatttgctaaacctatttataacgatccttcacttgtaaaatcagatacaaatgatgcagtagtaacgaatgatcaatcaagttcagtcgcaagtaatcaaacaaacacgaatacatctaatcaaaatacatcaacgatcaacaatgctaataatcaaccgcaggcaacgaccaatatgagtcaacctgcacaaccaaaatcgtcaacgaatgcagatcaagcgtcaagccaaccagctcatgaaacaaattctaatggtaatactaacgataaaacgaatgagtcaagtaatcagtcggatgttaatcaacagtatccaccagcagatgaatcactacaagatgcaattaaaaacccggctatcatcgataaagaacatacagctgataattggcgaccaattgattttcaaatgaaaaatgataaaggtgaaagacagttctatcattatgctagtactgttgaaccagcaactgtcatttttacaaaaacaggaccaataattgaattaggtttaaagacagcttcaacatggaagaaatttgaagtttatgaaggtgacaaaaagttaccagtcgaattagtatcatatgattctgataaagattatgcctatattcgtttcccagtatctaatggtacgagagaagttaaaattgtgtcatctattgaatatggtgagaacatccatgaagactatgattatacgctaatggtctttgcacagcctattactaataacccagacgactatgtggatgaagaaacatacaatttacaaaaattattagctccgtatcacaaagctaaaacgttagaaagacaagtttatgaattagaaaaattacaagagaaattgccagaaaaatataaggcggaatataaaaagaaattagatcaaactagagtagagttagctgatcaagttaaatcagcagtgacggaatttgaaaatgttacacctacaaatgatcaattaacagatttacaagaagcgcattttgttgtttttgaaagtgaagaaaatagtgagtcagttatggacggctttgttgaacatccattctatacagcaactttaaatggtcaaaaatatgtagtgatgaaaacaaaggatgacagttactggaaagatttaattgtagaaggtaaacgtgtcactactgtttctaaagatcctaaaaataattctagaacgctgattttcccatatatacctgacaaagcagtttacaatgcgattgttaaagtcgttgtggcaaacattggttatgaaggtcaatatcatgtcagaattataaatcaggatatcaatacaaaagatgatgatacatcacaaaataacacgagtgaaccgctaaatgtacaaacaggacaagaaggtaaggttgctgatacagatgtagctgaaaatagcagcactgcaacaaatcctaaagatgcgtctgataaagcagatgtgatagaaccagagtctgacgtggttaaagatgctgataataatattgataaagatgtgcaacatgatgttgatcatttatccgatatgtcggataataatcacttcgataaatatgatttaaaagaaatggatactcaaattgccaaagatactgatagaaatgtggataaagatgccgataatagcgttggtatgtcatctaatgtcgatactgataaagactctaataaaaataaagacaaagtcatacagctgaatcatattgccgataaaaataatcatactggaaaagcagcaaagcttgacgtagtgaaacaaaattataataatacagacaaagttactgacaaaaaaacaactgaacatctgccgagtgatattcataaaactgtagataaaacagtgaaaacaaaagaaaaagccggcacaccatcgaaagaaaacaaacttagtcaatctaaaatgctaccaaaaactggagaaacaacttcaagccaatcatggtggggcttatatgcgttattaggtatgttagctttattcattcctaaattcagaaaagaatctaaa

SEQ ID NO: 4 - DNA, 1272 bp, Staphylococcus aureus
atgtcagattttaatcatacagatcattctacaacaaaccatagccaaacacctagatacagaagacctaaatttccatggtttaaaacagtcatcgttgcattgattgctggaattattggtgcacttctagtacttggtataggcaaagtattaaatagtacaattttaaataaagatggttcaactgttcagacaacaaataataaaggtggcaatcaattagacggtcaaagcaagaaattcggtaccgttcatgaaatgataaaatctgtctcccctacaattgttggagttattaacatgcaaaaagcatcaagtgtagacgacttattaaaaggcaaatcatctaaaccatctgaagctggagtaggttcaggtgttatctatcaaataaacaacaattcagcttatatcgttacaaacaatcatgttattgatggcgcaaatgaaattagagtccaattacataataaaaaacaagttaaagcgaaattagttggtaaagatgcagtaactgatattgctgtacttaaaattgaaaatacaaaaggtattaaagcgattcaatttgccaactcttcaaaagtacaaactggcgatagcgtattcgcaatgggtaacccattaggattacaatttgctaactctgtaacatctggtatcatttcagcaagcgaacgtacgattgacgctgagacaactggtggcaatacaaaagttagcgttcttcaaacagatgctgctattaacccaggtaactcaggtggcgcattagtagatattaatggtaatttagttggtattaactcaatgaaaattgctgcgacacaagttgaaggtatcgggtttgctattccaagtaatgaagttaaagtaacaattgaacaacttgtaaaacatggtaaaattgaccgcccttcgattggtattggtttaattaatttgaaagatattcctgaagaagagcgcgagcaacttcatactgatagagaagacggtatttatgtcgccaaagctgatagtgatattgatcttaaaaaaggtgatattattacagaaattgatggcaagaaaattaaagatgatgttgatttaagaagctatttatatgaaaataaaaaacctggtgaatcagtcactgttaccgttatccgtgatggtaaaacaaaagaagttaaagtgaaattaaaacaacaaaaagaacaaccaaaacgtcaaagccgatcagaacgtcaatcacctggccaaggcgatagagatttctttaga

SEQ ID NO: 5 - DNA, 1167 bp, Staphylococcus aureus
ttgatgattaatgaaagagaagtgtttattttgatatatctagataatgcggcamcgacgaaagcatttgaagaagtgttagatacttatttaaaagtaaatcaatcaatgtattataatccgaatagtccgcataaagctggtttgcaggcaaatcaattactacaacaagcaaaaacccaaattaatgcaatgattaattcaaaaacaaattatgatgttgtattcactagtggtgcaactgaatccaataatcttgctttaaaaggtattgcctatcgtaaatttgatacagcgaaggaaataattacatccgtgttagagcatccgtccgtattagaggttgtaagatatttggaagcacacgaaggatttaaagttaaatatgttgatgtaaagaaagatggcagtattaacttagaacacttcaaagaattaatgtcagacaaagtcggtttagtaacatgtatgtatgtaaataatgtaactggacaaatacagcctattccacaaatggctaaagttataaaaaattatcctaaggcacattttcatgtagatgcggttcaagcattcggcaaaatttcaatggatctcaataacatagatagtattagtttaagtggacacaagtttaatggtttaaaaggacaaggcgtcttacttgtaaatcacattcaaaatgttgaaccaactgtccatggtggtggtcaagaatatggcgttagaagtggaacagttaatttgccaaatgatattgcaatggttaaagcgatgaagatagctaatgaaaactttgaagcattgaatgcatttgttactgagttaaataatgacgtccgtcaatttttaaataaatatcatggagtttatattaattcttcaacttcaggttcaccattcgttttaaatattagttttcctggcgtaaaaggtgaagtattagttaatgctttttcaaaatatgacattatgatatctacgacaagtgcttgttcatctaaacgtaataaattaaatgaagtattggctgcaatgggattatcagacaaatctattgaaggtagtataagattatcatttggggctactacaactaaagaagatatagcgaggtttaaagaaatatttatcatcatttatgaggaaattaaggagttgctaaaa

SEQ ID NO: 6 - DNA, 2151 bp, Staphylococcus aureus
gtgaaccaacaacaggagaaaacaacaacaacgccaacaacaattaatccattaacgggagaaaaagtaggcgaaggtgaaccaacaacagaagtaacaaaagaaccagtagatgaaatcacacaattcggtggagaagaagtaccacaaggtcataaagatgagttcgatccaaacttaccaattgacggtacagaagaagtaccaggtaaaccaggcatcaagaatcctgaaacaggtgaagtagtaacacctccggttgacgatgtcacaaaacatggtccaaaagcaggcgaaccagaggttactaaagaagaaataccattcgagaaaaaacgtgagttcaatccagacttaaaaccaggtgaagagaaagtaacgcaagaaggacaaactggagagaaaacaacaacaacgccaacaacaattaatccattaacgggagaaaaagtaggcgaaggtgaaccaacaacagaagtaacaaaagaaccagtagatgaaatcacacaattcggtggagaagaagtaccacaaggtcataaagatgagttcgatccaaacttaccaattgacggtacagaagaagtaccaggtaaaccaggcatcaagaatcctgaaacaggtgaagtagtaacaccaccagtagacgatgtcacaaaacatggtccaaaagcaggcgaaccagaggttactaaagaagaaattccatatgaaactaaacgcgtattagatccaacaatggaaccaggtagtcctgataaagtagctcaaaaaggtgaaaatggtgaaaaaacaacaacaacaccaactacaattaatccattaacgggagaaaaagtaggcgaaggcgaaccaacaacggaagtaacgaaagaaccaatagacgaaattgttaactatgcacctgaaattattcctcatggtacacgtgaagaaattgatccaaacttaccagaaggtgaaactaaagttatcccaggtaaagatggcttgaaagatcctgaaactggagaaatcattgaagaaccacaagatgaagtaatcatccatggtgctaaagatgattcagatgcggacagcgattcagacgcagatagcgattctgatgcagacagcgactcagacgcagatagcgactctgatgcggacagcgattcagacagcgatagcgattcagattcagatagcgactctgatgcggacagcgattcagacgcagatagcgattcagattcagatagtgactctgatgcggacagcgactcagacgcagatagcgactctgatgcggacagcgactcagacgcagatagcgattctgattcagacagcgactcagacgcagatagcgactcagattcagacagcgattcagacgcagatagcgactcagacgcagatagcgattcagacgcagatagcgactcagacgcagatagcgattcagattcagatagcgactctgatgcggacagcgatagcgattcagattcagacagcgactcagacgcagatagcgattcagacagcgattcagacgcagatagcgactctgatgcggacagcgactcagacgcagatagcgactcagacgcagatagcgattcagattcagacagcgactcagattcagacagcgatagcgattcagattcagacagagactcagacgcagatagcgactcagacgcagatagcgactcagattcagacagcgattcagacgcagatagcgattcagattcagatagtgactctgatgcggacagcgattcagacgcagatagcgactcagattcagacgcagatagcgattctgattcagacagcgactcagacgcagatagcgactctgatgcggacagcgactcagacgcagatagcgattctgatgcagacagcgactcagacagcgatagcgattctgattcagacagcgattcagacgcagatagcgactctgatgcggacagcgattcagacgcagatagagatcataatgacaaaacagataaaccaaataataaagagttaccagatactggtaatgatgctcaaaataatggcacattatttggttcactattcgctgcgcttggaggattattcttagttggcagacgtcgtaaaaacaaaaataatgaagaaaaa

SEQ ID NO: 7 - DNA, 1359 bp, Staphylococcus aureus
gtgaagtcattgaagacggtgattgggatgaataataaggagcatattaaatctgtcattttagcactactcgtcttgatgagtgtcgtattgacatatatggtatggaacttttctcctgatattgcaaatgtcgacaatacagatagtaagaagagtgaaacgaaacctttaacgacacctatgacagccaaaatggatacaactattacgccatttcagattattcattcgaaaaatgatcatccagaaggaacgattgcgacggtatctaatgtgaataaactgacgaaacctttgaaaaataaagaagtgaagtccgtggaacatgttcgtcgtgatcataacttgatgattcctgatttgaacagtgattttatattattcgattttacgtatgatttaccgttatcaacatatcttggtcaagtactgaacatgaatgcgaaagtaccaaatcatttcaatttcaatcgtttggtcatagatcatgatgctgatgataatatcgtgctttatgctataagcaaagatcgccacgattacgtaaaattaacaactacaacgaaaaatgatcattttttagatgcattagcagcagtgaaaaaagatatgcaaccatacacagatatcatcacaaacaaagatacaattgatcgtacgacgcatgtttttgcaccaagtaaacctgaaaagttaaaaacatatcgcatggtatttaacacgattagtgttgagaaaatgaatgctatactatttgacgattcaaccatcgttcgtagttcaaagagtggtgttacaacctacaacaataatacaggtgtcgcaaactataacgataaaaatgaaaaatatcattataaaaacctgtccgaagatgaagcgagttccagcaaaatggaagaaacgattccaggaacctttgattttattaatggtcatggtggtttcttaaacgaagactttagattgtttagtacgaataatcagtcaggcgagttaacatatcaacgtttccttaatggttatccaacgtttaataaagaaggttctaatcaaattcaagtcacttggggtgaaaaaggcgtctttgactatcgtcgttcgttattacgcaccgacgttgttttaaatagtgaggataataaatcgttgccgaaattagagtctgtacgttcaagcttagcgaacaatagtgatattaattttgaaaaagtaacaaacatcgctatcggttacgaaatgcaggataattcagatcataatcacattgaagtgcagattaacagtgaactcgtaccgcgttggtatgtagaatatgatggcgaatggtatgtttataacgatgggaggcttgaa

SEQ ID NO: 8 - DNA, 6783 bp, Staphylococcus aureus
atgagtaaaagacagaaagcatttcatgacagcttagcaaacgaaaaaacaagagtaagactttataaatctggaaaaaattgggtaaaatccggaattaaagaaatagaaatgttcaaaattatggggctaccatttattagtcatagtttagtgagtcaagataatcaaagcattagtaaaaaaatgacgggatacggactgaaaactacggcggttattggtggtgcattcacggtaaatatgttgcatgaccagcaagcttttgcggcttctgatgcaccattaacttctgaattaaacacacaaagtgaaacagtaggtaatcaaaactcaacgacaatcgaagcatcaacatcaacagccgattccacaagtgtaacgaaaaatagtagttcggtacaaacatcaaatagtgacacagtctcaagtgaaaagtctgaaaaggtcacttcgacaactaatagtacaagcaatcaacaagagaaattgacatctacatcagaatcaacatcctcaaagaatactacatcaagttctgatactaaatctgtagcttcaacttcaagtacagaacaaccaattaatacatcaacaaatcaaagtactgcatcaaataacacttcacaaagcacaacgccatcttcggtcaacttaaacaaaactagcacaacgtcaactagcaccgcaccagtaaaacttcgaactttcagtcgcttagctatgtcaacatttgcgtcagcagcgacgacaaccgcagtaactgctaatacaattacagttaataaagataacttaaaacaatatatgacaacgtcaggtaatgctacctatgatcaaagtaccggtattgtgacgttaacacaggatgcatacagccaaaaaggtgctattacattaggaacacgtattgactctaataagagttttcatttttctggaaaagtaaatttaggtaacaaatatgaagggcatggaaatggtggagatggtatcggttttgccttttcaccaggtgtattaggtgaaacagggttaaacggtgccgcagtaggtattggtggcttaagtaacgcatttggcttcaaattggatacgtatcacaatacatctaaaccaaattcagctgcaaaggcgaatgctgacccatctaatgtagctggtggaggtgcgtttggtgcatttgtaacaacagatagttatggtgttgcgacaacgtatacatcaagttcaacagctgataatgctgcgaagttaaatgttcaacctacaaataacacgttccaagattttgatattaactataatggtgatacaaaggttatgactgtcaaatatgcaggtcaaacatggacacgtaatatttcagattggattgcgaaaagtggtacgaccaacttttcattatcaatgacagcctcaacaggtggcgcgacaaatttacaacaagtacaatttggaacattcgaatatacagagtctgctgttacacaagtgagatacgttgatgtaacaacaggtaaagatattattccaccaaaaacatattcaggaaatgttgatcaagtcgtgacaatcgataatcagcaatctgcattgactgctaaaggatataactacacgtccgtcgatagttcatatgcgtcaacttataatgatacaaataaaactgtaaaaatgacgaatgctggacaatcagtgacatattattttactgatgtaaaagcaccaactgtaactgtaggcaatcaaaccatagaagtgggtaaaacaatgaatcctattgtattgactacaacggataatggtactgggactgtgacaaatacagttacaggattaccaagcggattaagttacgatagtgcaacgaattcaatcattgggacaccaacaaaaattggtcaatcaacagtgacagttgtgtctactgaccaagcaaataacaaatcgacgacaacttttacaataaatgttgtggatacgacagcaccaacagtgacaccaataggagatcaatcatcagaagtgtattcaccaatatccccgattaaaattgctacgcaagataacagtggaaatgcggtgacgaatacagtgactggattgccatccggactaacatttgatagtacaaataatactattagtggtacaccaacaaacattggtacaagtactatatcaatcgtttctacagatgcgagcggtaacaaaacgacgacaacttttaaatatgaagtaacaagaaatagcatgagtgattccgtatcaacatcaggaagtacacaacaatctcaaagtgtgtcaacaagtaaagctgactcacaaagtgcatcaacgagtacatcaggatcgattgtggtatctacatcagctagtacctcgaaatcgacaagtgtaagcctatctgattctgtgagtgcatctaagtcattaagcacatctgaaagtaatagtgtatcaagctcaacaagcacaagtttagtgaattcacaaagtgtatcatcaagcatgtcggattcagctagtaaatcaacatcattaagcgattctatttcaaactctagcagtactgaaaaatccgaaagtctatcaacaagtacatctgattcattgcgtacatcaacatcactcagtgactcattaagtatgagtacatcaggaagcttgtctaagtcacaaagcttatcaacgagtatatcagggtcgtctagtacatcagcatcattaagtgacagtacatcgaatgcaattagtacatcaacatcattgagcgagtcagctagcacctcggactctatcagtatttcaaatagcatagccaactctcaaagtgcgtcaacaagcaaatcagattcacaaagtacatcaatatcattaagtacaagtgattcaaaatcgatgagtacatcagaatcattgagcgattcgacgagcacaagtggttctgtttctggatcactaagcatagcagcatcacaaagtgtctcaacaagtacatcagactcgatgagtacttcagagatagtaagtgactctatcagtacaagtgggtcattatctgcatcagacagtaaatcaatgtccgtaagtagttcaatgagcacgtctcagtcaggtagtacatcagaatcattaagtgattcacaaagtacatctgattctgatagtaagtcattatcacaaagtactagtcaatcaggttcaacaagtacatcaacgtcgacaagtgcttcagtacgtacttcggaatcacaaagtacgtctggttcaatgagtgcaagtcaatccgattcaatgagcatatcaacgtcgtttagtgattcaacgagtgatagcaaatcagcatcaactgcatcaagtgaatcaatatcacaaagtgcttctacgagcacatctggttcggtaagtacttcgacatcgttaagtacaagtaattcagaacgtacatcaacatctatgagtgattccacaagcttaagtacatcagagtctgattcaataagtgaatcaacgtcaacgagcgactctataagtgaagcaatatctgcttcagagagcacgtttatatcattaagtgaatcaaatagtactagcgattcagaatcacaaagtgcatctgcctttttaagtgaatcattaagtgaaagtacgtctgaatcaacatcagagtcagtgagtagttcgacaagtgagagtacgtcattatcagacagtacatcagaatctggtagcacatcaacatcattaagtaattcaacaagtggtagtacgtccatttcaacatcgacaagtatcagtgaatcaacgtcaacgtttaagagcgagagtgtttcaacatcactgagtatgtcaacgagtacaagtttgtctgactctacaagtttgtcaacatcattaagtgattccacaagtgatagtaagtctgattcattaagtacatcaatgtcgacaagtgattcaatcagtacaagtaaatctgattccattagtacatccacatcattaagtggttctacaagtgaaagtaaatccgattcaacatcaatgagcataagtatgtctcaatcaacatcaggaagtacaagtacgtcaacgagtacaagtttgtctgactcaacgagtacatcattgtcactaagtgcctcaatgaatcaaagcggagtagactcaaactcagcaagccaaagtgcctcaaactcaacaagtacaagcacgagcgaatccgattcacaaagcacatcatcatatacaagtcagtcaacaagccaaagtgaatccacatcgacatcaacgtcactaagcgattcaacaagtatatctaaaagtacgagtcaatcaggttcggtaagcacatcagcgtcattaagtggttcagagagtgaatctgattcacaaagtatctcaacaagtgcaagtgagtcaacatcagaaagtgcgtcaacatcactcagtgactcaacaagtacaagtaactcaggatcagcaagtacgtcaacatcgctcagtaactcagcaagcgcaagtgaatccgatttgtcgtcaacatctttaagtgattcaacatctgcgtcaatgcaaagcagtgaatccgattcacaaagcacatcagcatcattaagtgattcgctaagtacatcaacttcaaaccgcatgtcgaccattgcaagtttatctacatcggtaagtacatcagagtctggctcaacatcagaaagtacaagtgaatccgattcaacatcaacatcattaagcgattcacaaagcacatcaagaagtacaagtgcatcaggatcagcaagtacatcaacatcaacaagtgactctcgtagtacatcagcttcaactagtacttcgatgcgtacaagtactagtgattcacaaagtatgtcgctttcgacaagtacatcaacaagtatgagtgattcaacgtcattatctgatagtgttagtgattcaacatcagactcaacaagtgcgagtacatctggttcgatgagtgtgtctatatcgttaagtgattcgacaagtacatcaacatcggctagtgaagtaatgagcgcaagcatatctgattcacaaagtatgtcagaatctgtaaatgattcagaaagtgtaagtgaatctaattctgaaagtgactctaaatcgatgagtggctcaacaagtgtcagtgattctggctcattgagcgtctcaacgtcattaagaaaatcagaaagtgtaagcgagtcaagttcattgagttgctcacaatcgatgagcgattcagtaagcacaagcgattcgtcatcattaagtgtatcgacgtcactaagaagttcagaaagcgtgagtgaatctgattcattaagtgattcaaaatcaacaagtggttcgacttcaacaagtacatctggttcattgagtacctcaacatcattaagtggttcagaaagcgtaagcgagtctacctcgctaagtgattcaatatcaatgagtgattctactagtacaagtgactccgactcattaagtggatcaatatctttaagtggttccacaagtcttagcacttcggattcattaagtgattcaaaatcattgagtagctcgcaaagtatgagtggatcagaatcaacgtcaacaagtgtgagcgattcgcagtcaagctcaacaagtaatagtcaatttgactctatgagcatcagtgcatcagaaagcgactcaatgtctacaagtgattcgtctagcatcagtggatcaaattcaacgagtacatcactttcaacatctgactcaatgagcggaagcgtatcagtttcaacatcgacaagtttaagtgactcaatatcaggttcaacaagtgtaagtgactcgagctcaacaagcacatctacatcattaagtgattcaatgtcacaaagccagtcaacaagtacaagtgcatctggttccttaagtacatcgatatcaacatcaatgtcaatgagtgctagtacatcgtcatcacaaagcacatcggtgtcgacatcattatcaacatcagacagtatcagtgattctacttcaataagtatcagtggttcacaaagtacagtagaatcagaatctacaagtgattcaacttctatcagtgactcagaatcattgagtacatcagattcagactcgacatcgacaagtacatcggactcaacaagtggttcaacttcaacaagcatatctgaatcattaagtacgtctggttcaggttcaacgagcgtatctgactcaacatcaatgagtgaatctaattcatcgagtgtttcaatgtcacaagacaaatccgactcaacatcaattagtgactcagaatcagtgtcaacaagcacatcaacgtcattgagcacatccgattcgacaagcacatccgaatcactgagtacatctatgtctggttcacaaagcatttctgactcaacatcaacaagtatgtccggctcaacaagtacatctgaatctaactcaatgcatccgtcagactcaatgagtatgcatcatactcacagcacgagcacatctcgcttatcaagtgaagcaacaacgagcacgagtgaatctcagtctacattaagtgcaacatctgaagtgactaaacataatggcacaccagcacaaagtgaaaaaagattgccagatacaggtgactcaataaaacaaaatggattactaggtggcgttatgacattattagttggtttaggtttaatgaagagaaagaaaaagaaagatgaaaatgatcaagatgattctcaagca

SEQ ID NO: 9 - DNA, 1857 bp, Staphylococcus aureus
atgcctaaaaataaaattttaatttatttgctatcaactacgctcgtattacctactttagtttcacctaccgcttatgctgatacacctcaaaaagatactacagctaagacaacatctcatgattcaaaaaaatctaatgacgatgaaacttctaaggatactacaagtaaagatattgataaagcagacaaaaataatacaagtaaccaagacaataacgacaaaaaatttaaaactatagacgacagcacttcagactctaacaatatcattgattttatttataagaatttaccacaaaccaatataaaccaattgctaaccaaaaataaatacgatgataattactcattaacaactttaatccaaaacttattcaatttaaattcggatatttctgattacgaacaacctcgtaatggcgaaaagtcaacaaatgattcgaataaaaacagtgacaatagcatcaaaaatgacactgatacgcaatcatctaaacaagataaagcagacaatcaaaaagcacctaaatcaaacaatacaaaaccaagtacatctaataagcaaccaaattcgccaaagccaacacaacctaatcaatcaaatagtcaaccagcaagtgacgataaagcaaatcaaaaatcttcatcgaaagataatcaatcaatgtcagattcggctttagactctattttggatcaatacagtgaagatgcaaagaaaacacaaaaagattatgcatctcaatctaaaaaagacaaaaatgaaaaatctaatacaaagaatccacagttaccaacacaagatgaattgaaacataaatctaaacctgctcaatcattcaataacgatgttaatcaaaaggatacacgtgcaacatcattattcgaaacagatcctagtatatctaacaatgatgatagcggacaatttaacgttgttgactcaaaagatacacgtcaatttgtcaaatcaattgctaaagatgcacatcgcattggtcaagataacgatatttatgcgtctgtcatgattgcccaagcaatcttagaatctgactcaggtcgtagtgctttagctaagtcaccaaaccataatttattcggtatcaaaggtgcttttgaagggaattctgttccttttaacacattagaagctgatggtaatcaattgtatagtattaatgctggattccgaaaatatccaagcacgaaagaatcactaaaagattactctgaccttattaaaaatggtattgatggcaatcgaacaatttataaaccaacatggaaatcggaagccgattcttataaagatgcaacatcacacttatctaaaacatatgctacagatccaaactatgctaagaaattaaacagtattattaaacactatcaattaactcagtttgacgatgaacgcatgccagatttagataaatatgaacgttctatcaaggattatgatgattcatcagatgaattcaaacctttccgtgaggtatctgatagtatgccatatccacatggccaatgtacttggtacgtatataaccgtatgaaacaatttggtacatctatctcaggtgatttaggtgatgcacataattggaataatcgagctcaataccgtgattatcaagtaagtcatacaccaaaacgtcatgctgctgttgtatttgaggctggacaatttggtgcagatcaacattacggtcatgtagcatttgttgaaaaagttaacagtgatggttctatcgttatttcagaatccaatgttaaaggattaggtatcatttctcatagaactatcaacgcagctgccgctgaagaattatcatatattacaggtaaa

SEQ ID NO: 10 - DNA, 1527 bp, Staphylococcus aureus
gtgaggaaattttcaagatatgcatttacaagtatggcagcattaaccttgttgagcactttatcaccagcagcattagcgattgattcaaaaaataaaccagctaattctgatattaaatttgaggtgactcaaaagagtgatgcggtcaaagcattaaaagaattgcctaaatccgaaaatgtaaaaaatatttatcaagattacgctgttactgatgtaaaaactgataaaaaaggatttacgcattatacattgcaaccgagtgttgatggtgttcatgcacctgacaaagaagtgaaagtacacgcagacaaatcaggaaaagtcgttttaatcaatggggatactgatgcgaagaaagtaaagccaacgaataaagtgacattaagtaaagatgacgcagccgacaaagcatttaaagcagttaagattgataagaataaagcgaaaaatcttaaagataaagtcattaaagaaaacaaagttgaaatcgatggtgacagtaataaatacgtttataatgttgagttaattacagtgacaccagaaatttcacattggaaagttaaaattgatgctcaaactggcgaaattttagaaaaaatgaacttagttaaagaagctgcagaaactggtaaaggaaaaggtgtacttggcgatacaaaagatatcaatatcaatagtattgacggtggatttagcctagaagatttaacgcatcaaggtaaattatcagcatttagctttaatgatcaaacaggtcaagcaacattgattactaatgaagatgaaaacttcgtaaaagatgagcaacgtgctggcgtagatgcaaattattacgctaaacaaacatatgattattacaaagacacatttggtcgtgaatcatatgacaaccaaggtagtccaattgtttcattaacgcatgttaataactacggtggtcaagataacagaaataatgccgcatggatcggtgacaaaatgatctatggtgatggtgatggtcgcacattcacaagtttatcgggtgcaaatgacgtagtagcacacgaattaacacacggtgtgacacaagagacagcgaacttagaatataaggaccagtcaggcgctctaaatgaaagcttttcagatgtttttggatactttgtagatgacgaggatttcttaatgggtgaagatgtctacacacctggaaaagagggagacgctttacgcagcatgtcaaacccagaacaatttggtcaaccagctcatatgaaagactatgtattcactgaaaaagataatggtggcgtacatacgaattctggaattccaaataaagcagcttataacgtgattcaagcaatagggaaatctaaatcagaacaaatttactaccgagcattaacggaatacttaacaagtaattcaaacttcaaagattgtaaagatgcattataccaagcggctaaagatttatatgacgagcaaacagctgaacaggtgtatgaagcatggaatgaagtaggcgtggag

SEQ ID NO: 11 - DNA, 2739 bp, Staphylococcus aureus
ttgaaaaaaagaattgattatttgtcgaataagcagaataagtattcgattagacgttttacagtaggtaccacatcagtaatagtaggggcaactatactatttgggataggcaatcatcaagcacaagcttcagaacaatcgaacgatacaacgcaatcttcgaaaaataatgcaagtgcagattccgaaaaaaacaatatgatagaaacacctcaattaaatacaacggctaatgatacatctgatattagtgcaaacacaaacagtgcgaatgtagatagcacaacaaaaccaatgtctacacaaacgagcaataccactacaacagagccagcttcaacaaatgaaacacctcaaccgacggcaattaaaaatcaagcaactgctgcaaaaatgcaagatcaaactgttcctcaagaagcaaattctcaagtagataataaaacaacgaatgatgctaatagcatagcaacaaacagtgagcttaaaaattctcaaacattagatttaccacaatcatcaccacaaacgatttccaatgcgcaaggaactagtaaaccaagtgttagaacgagagctgtacgtagtttagctgttgctgaaccggtagtaaatgctgctgatgctaaaggtacaaatgtaaatgataaagttacggcaagtaatttcaagttagaaaagactacatttgaccctaatcaaagtggtaacacatttatggcggcaaattttacagtgacagataaagtgaaatcaggggattattttacagcgaagttaccagatagtttaactggtaatggagacgtggattattctaattcaaataatacgatgccaattgcagacattaaaagtacgaatggcgatgttgtagctaaagcaacatatgatatcttgactaagacgtatacatttgtctttacagattatgtaaataataaagaaaatattaacggacaattttcattacctttatttacagaccgagcaaaggcacctaaatcaggaacatatgatgcgaatattaatattgcggatgaaatgtttaataataaaattacttataactatagttcgccaattgcaggaattgataaaccaaatggcgcgaacatttcttctcaaattattggtgtagatacagcttcaggtcaaaacacatacaagcaaacagtatttgttaaccctaagcaacgagttttaggtaatacgtgggtgtatattaaaggctaccaagataaaatcgaagaaagtagcggtaaagtaagtgctacagatacaaaactgagaatttttgaagtgaatgatacatctaaattatcagatagctactatgcagatccaaatgactctaaccttaaagaagtaacagaccaatttaaaaatagaatctattatgagcatccaaatgtagctagtattaaatttggtgatattactaaaacatatgtagtattagtagaagggcattacgacaatacaggtaagaacttaaaaactcaggttattcaagaaaatgttgatcctgtaacaaatagagactacagtattttcggttggaataatgagaatgttgtacgttatggtggtggaagtgctgatggtgattcagcagtaaatccgaaagacccaactccagggccgccggttgacccagaaccaagtccagacccagaaccagaaccaacgccagatccagaaccaagtccagacccagaaccggaaccaagcccagacccggatccggattcggattcagacagtgactcaggctcagacagcgactcaggttcagatagcgactcagaatcagatagcgattcggattcagacagtgattcagattcagacagcgactcagaatcagatagcgattcagaatcagatagcgactcagattcagatagcgattcagattcagatagcgattcagattcagatagcgattcggattcagacagtgattcagattcagacagcgactcagaatcagatagcgactcagaatcagatagtgagtcagattcagacagtgactcggactcagacagtgattcagactcagatagcgattcagactcagatagcgattcagattcagacagcgactcagattcagacagcgactcagactcagatagcgactcagactcagacagcgactcagattcagatagcgattcagactcagacagcgactcagactcagacagcgactcagactcagatagcgactcagattcagatagcgattcagactcagacagcgactcagattcagatagcgattcggactcagacagcgattcagattcagacagcgactcagactcggatagcgattcagattcagatagcgattcggattcagacagtgattcagattcagacagcgactcagactcggatagcgactcagactcagacagcgattcagactcagatagcgactcagactcggatagcgactcggattcagatagcgactcagactcagatagtgactccgattcaagagttacaccaccaaataatgaacagaaagcaccatcaaatcctaaaggtgaagtaaaccattctaataaggtatcaaaacaacacaaaactgatgctttaccagaaacaggagataagagcgaaaacacaaatgcaactttatttggtgcaatgatggcattattaggatcattactattgtttagaaaacgcaagcaagatcataaagaaaaagcg

SEQ ID NO: 12 - DNA, 699 bp, Staphylococcus aureus
atgaaaaagacaattatggcatcatcattagcagtggcattaggtgtaacaggttacgcagcaggtacaggacatcaagcacacgctgctgaagtaaacgttgatcaagcacacttagttgacttagcgcataatcaccaagatcaattaaatgcagctccaatcaaagatggtgcatatgacatccactttgtaaaagatggtttccaatataacttcacttcaaatggtactacatggtcatggagctatgaagcagctaatggtcaaactgctggtttctcaaacgttgcaggtgcagactacactacttcatacaaccaaggttcaaatgtacaatcagtaagctacaatgcacaatcaagtaactcaaacgttgaagctgtttcagctccaacttaccataactacagcacttcaactacttcaagttcagtgagattaagcaatggtaatactgcaggtgctactggttcatcagcagctcaaatcatggctcaacgtactggtgtttcagcttctacatgggctgcaatcatcgctcgtgaatcaaatggtcaagtaaatgcttacaacccatcaggtgcttcaggtttattccaaactatgccaggttggggtccaacaaacactgttgaccaacaaatcaacgcagctgttaaagcatacaaagcacaaggtttaggtgcttggggattc

SEQ ID NO: 13 - DNA, 783 bp, Staphylococcus aureus
ttgggaggatatttaattatgaaaaaaatcgttacagctacaatcgctacagcaggacttgccactatcgcatttgcaggacatgatgcacaagccgcagaacaaaataacaatggatataattctaatgacgctcaatcatacagctatacgtatacaattgatgcacaaggtaattatcattacacttggacaggaaattggaatccaagtcaattaacgcaaaacaacacatactactacaacaactacaatacttatagttataacaatgcatcttacaataactactataatcattcatatcaatacaataactatacaaacaatagtcaaacagcaacaaataactattatactggtggttcaggtgcaagttatagcacaacaagtaataatgttcatgtgactacaactgcagcgccatcttcaaatggtcgttcaatttctaatggttatgcatcaggaagtaacttatatacttcaggacaatgtacttattatgtatttgatcgtgttggtgggaaaattggttcaacatggggtaacgcaagtaattgggctaacgcagctgcatcatctggctatacagtgaacaatacaccaaaagttggtgctatcatgcaaacaacacaaggctattacggtcatgttgcttacgttgaaggcgttaacagcaacggttctgttcgtgtttcagaaatgaactatggacatggtgctggtgtggttacgtctcgtacaatttcagcaaaccaagcaggttcatataatttcattcat

SEQ ID NO: 14 - DNA, 2406 bp, Staphylococcus aureus
gtggctaatacgaaaaaaacaacattagatatcactggtatgacttgtgccgcatgttcaaatcgtatcgaaaagaaactgaataaacttgatgacgttaatgcccaagtgaatttaactacagagaaagcaactgttgagtataaccctgatcaacatgatgtccaagaatttattaatacgattcaacatttaggttacggtgtcgctgtagaaactgtcgaattagacattacaggtatgacttgtgctgcatgctcaagccgtattgaaaaagtgttaaataaaatggacggcgttcaaaatgcaacggtcaatttaacaacagagcaagctaaagttgactattatcctgaagaaacagatgctgataaacttgtcactcgcattcaaaaattaggttatgacgcgtctattaaagataacaataaagatcaaacgtcacgcaaagctgaagcgctacaacataaattgattaagcttatcatatcagcagtattatctttaccactattaatgttaatgtttgtacatcttttcaatatgcatataccagcactatttacgaatccatggttccaatttattttagctacacctgtacaatttattattggatggcaattttatgtaggtgcttataaaaacttaagaaatggtggcgccaatatggatgtacttgttgctgttggtacaagtgcagcatatttttacagtatttatgaaatggttcgttggctaaatggctcaacaacgcaaccgcatttatactttgaaacaagcgccgtactaattaccttaatcttattcggtaagtatttagaagctagagcgaagtctcaaacaaccaatgcgcttggcgaattattaagtttacaagctaaagaagcacgcattttaaaagatggtaatgaagtgatgattcctctaaatgaagtacatgttggagatacacttatcgttaaaccaggtgaaaagatacctgttgatggcaaaattattaaaggtatgactgccatcgacgaatctatgttaacaggtgaatctatccctgttgagaagaatgttgatgatactgtaattggttcaacgatgaacaaaaacggtactattactatgacagcaacaaaagttggcggggacaccgcgttggcaaatattattaaagttgtcgaagaagctcaaagttctaaagcgccgattcaacgattggcagatattatttctggttatttcgttcctatcgttgttggtatcgcactattaacatttatcgtgtggattactttagttacaccaggtacatttgaacctgcacttgttgcgagtatttccgttctcgtcattgcttgtccatgcgcattgggacttgctacaccaacttctattatggtaggtactggtcgcgctgctgaaaatggtattttatttaaaggtggcgagtttgttgaacgcacacatcaaattgataccatcgttttagataagacgggtaccattacaaatggtcgtccagtcgtgacagattatcatggtgacaatcaaacgctacaactacttgctactgctgaaaaagattctgaacacccattggcagaagccattgtcaattatgcaaaagaaaagcaattaatattaactgagacaacaacatttaaagcagtacctggccatggtattgaagcaacgattgatcatcaccatatattggttggtaaccgtaaattaatggctgacaatgatattagcttgcctaagcatatttctgatgatttaacacattatgaacgagatggtaaaactgctatgctcattgctgttaattattcattaactggtatcatcgcagtggcagatactgtcaaagatcatgccaaagatgctataaaacaattgcatgatatgggcattgaagttgccatgttaactggcgataataaaaacactgctcaagccattgcaaaacaagtaggcatagatactgttattgcagatattttaccagaagaaaaagctgcacaaattgcgaaactacagcaacaaggtaagaaggttgcgatggttggtgacggtgtaaatgatgcacctgcattagttaaagctgatatcggtatcgccattggtacaggtacagaagttgccattgaagcagctgatattactattcttggtggcgacttgatgcttattcctaaagccatttatgcaagtaaagcaaccattcgtaatattcgtcaaaatctattttgggcattcggctataatattgccggtatccctatagctgcattgggcttacttgcgccatgggttgctggtgctgcaatggcactaagttcagtaagtgttgtcacaaacgcacttagattgaaaaagatgcgattagaaccacgccgtaaagatgcc

SEQ ID NO: 15 - DNA, 897 bp, Staphylococcus aureus
atgtttgattcaattagagagactatagattatgccgtagaaaataatatgtcatttgcggatatcatggttaaagaagaaatggaattaagcggtaaatcacgtgatgaagtgcgagcgcaaatgaaacaaaatttagatgtcatgcgagacgcagtaatcaaagggacgacaggtgatggggttgaaagtgtaacgggctacactggtcatgatgctgctaaactacgtgattataatgaaacacatcatgctttgtctggatatgaaatgattgacgcagtcaaaggtgccattgcaacaaatgaagtcaatgctgcgatgggtattatttgtgcaacgccaacagctggttcctcgggtaccattcccggtgcactttttaaattagaaaaaacacatgatttaacagaagagcaaatgattgatttcttattcacttcagcattgtttgggcgtgtcgtagcaaacaatgcaagtgtagctggtgcaacaggtggctgccaagctgaagttggttcagcatctgcaatggccgcagctgcagcagtagctatattcggaggatcaccagaagcatccgggcacgctatggcattagcgataagtaatttattaggtttagtttgtgatccagtagccggacttgttgaaattccttgtgttatgagaaatgcaattggttcgggtaacgctttaatttcagcagatttagcattagcaggtattgaaagtagaatccctgttgatgaagttattgaagcaatggataaggttggtcgtaaccttcctgcatcattacgtgaaactggattgggtggactagcaggcacaccaactggcgaagcaattaaacgtaaaatctttggcacagctgaagatatggttaaaaataat

SEQ ID NO: 16 - DNA, 3054 bp, Staphylococcus aureus
gtgaaaaacaatcttaggtacggcattagaaaacataaattgggagcagcatcagtattcttaggaacaatgatcgttgttgggatgggacaagacaaagaagctgcagcatcagaacaaaagacaactacagtagaagaaaatgggaattcagctactgataataaaacaagtgaaacacaaacaactgcaactaacgttaatcatatagaagaaactcaatcatataacgcaacagtaacagaacaaccgtcaaacgcaacacaagtaacaactgaagaagcaccaaaagcagtacaagcaccacaaactgcacaaccagcaaatatagaaacagttaaagaagaggtagttaaggaagaagcgaaacctcaagttaaggaaacaacacaatctcaagacaatagcggagatcaaagacaagtagatttaacacctaaaaaggctacacaaaatcaagtcgcagaaacacaagttgaagtggcacagccaagaacggcatcagaaagtaagccacgtgtgacaagatcagcagatgtagcggaagctaaggaagctagtaacgcgaaagtggaaacgggtacagatgtaacaagtaaagttacagtagaaattggttctattgaggggcataacaatacaaataaagtagaacctcatgcaggacaacgagcggtactaaaatataagttgaaatttgagaatggtttacatcaaggtgactactttgactttactttatcaaataatgtaaatacgcatggcgtatcaactgctagaaaagtaccagaaattaaaaatggttcagtcgtaatggcgacaggtgaagttttagaaggtggaaagattagatatacatttacaaatgatattgaagataaggttgatgtaacggctgaactagaaattaatttatttattgatcctaaaactgtacaaactaatggaaatcaaactataacttcaacactaaatgaagaacaaacttcaaaggaattagatgttaaatataaagatggtattgggaattattatgccaatttaaatggatcgattgagacatttaataaagcgaataatagattttcgcatgttgcatttattaaacctaataatggtaaaacgacaagtgtgactgttactggaactttaatgaaaggtagtaatcagaatggaaatcaaccaaaagttaggatatttgaatacttgggtaataatgaagacatagcgaagagtgtatatgcaaatacgacagatacttctaaatttaaagaagtcacaagtaatatgagtgggaatttgaatttacaaaataatggaagctattcattgaatatagaaaatctagataaaacttatgttgttcactatgatggagagtatttaaatggtactgatgaagttgattttagaacacaaatggtaggacatccagagcaactttataagtattattatgatagaggatataccttaacttgggataatggtttagttttatacagtaataaagcgaacggaaatgggaaaaatggtccgattattcaaaataataaatttgaatataaagaagatacaattaaagaaactcttacaggtcaatatgataagaatttagtaactactgttgaagaggaatatgattcatcaactcttgacattgattaccacacagctatagatggtggaggtggatatgttgatggatacattgaaacaatagaagaaacggattcatcagctattgatatcgattaccatactgctgtggatagcgaagcaggtcacgttggaggatacactgagtcctctgaggaatcaaatccaattgactttgaagaatctacacatgaaaattcaaaacatcacgctgatgttgttgaatatgaagaagatacaaacccaggtggtggtcaggttactactgagtctaacttagttgaatttgacgaagagtctacaaaaggtattgtaactggcgcagtgagcgatcatacaacagttgaagatacgaaagaatatacaactgaaagtaatctgattgaattagtggatgaattacctgaagagcatggtcaagcacaaggaccagtcgaggaaattactgaaaacaatcatcatatttctcattctggtttaggaactgaaaatggtcacgggaattatgacgtgattgaagaaatcgaagaaaatagccacgttgatattaagagtgaattaggttatgaaggtggccaaaatagcggtaaccagtcattcgaggaagacacagaagaagacaaacctaaatatgaacaaggtggcaatatcgtagatatcgattttgatagtgtacctcaaattcatggtcaaaataaaggtaatcagtcattcgaggaagatacagaaaaagacaaacctaagtatgaacatggcggtaacatcattgatatcgacttcgacagtgtgccacatattcacggattcaataagcacactgaaattattgaagaagatacaaataaagataaaccaagttatcaattcggtggacacaatagtgttgactttgaagaagatacacttccaaaagtaagcggccaaaatgaaggtcaacaaacgattgaagaagatacaacacctccaatcgtgccaccaacgccaccgacaccagaagtaccaagtgagccggaaacaccaacgccaccaacaccagaagtaccaagtgagccggaaacaccaacaccaccgacaccagaagtgccgagtgagccagaaactccaacaccgccaacaccagaggtaccagctgaacctggtaaaccagtaccacctgccaaagaagaacctaaaaagccttctaaaccagtggaacaaggtaaagtagtaacacctgttattgaaatcaatgaaaaggttaaagcagtggcaccaactaaaaaaccacaatctaagaaatctgaactacctgaaacaggtggagaagaatcaacaaacaaaggtatgttgttcggcggattattcagcattctaggtttagcattattacgcagaaataaaaagaatcacaaagca

SEQ ID NO: 17 - DNA, 2844 bp, Staphylococcus aureus
ttgcatttaagggagaatattatagtgaaaagcaatcttagatacggcataagaaaacacaaattgggagcggcctcagtattcttaggaacaatgatcgttgttggaatgggacaagaaaaagaagctgcagcatcggaacaaaacaatactacagtagaggaaagtgggagttcagctactgaaagtaaagcaagcgaaacacaaacaactacaaataacgttaatacaatagatgaaacacaatcatacagcgcgacatcaactgagcaaccatcacaatcaacacaagtaacaacagaagaagcaccgaaaactgtgcaagcaccaaaagtagaaacttcgcgagttgatttgccatcggaaaaagttgctgataaggaaactacaggaactcaagttgacatagctcaaccaagtaacgtctcagaaattaaaccaagaatgaaaagatcaactgacgttacagcagttgcagagaaagaagtagtggaagaaactaaagcgacaggtacagatgtaacaaataaagtggaagtagaagaaggtagtgaaattgtaggacataaacaagatacgaatgttgtaaatcctcataacgcagaaagagtaaccttgaaatataaatggaaatttggagaaggaattaaggcgggagattattttgatttcacattaagcgataatgttgaaactcatggtatctcaacactgcgtaaagttccggagataaaaagtacagatggtcaagttatggcgacaggagaaataattggagaaagaaaagttagatatacgtttaaagaatatgtacaagaaaagaaagatttaactgctgaattatctttaaatctatttattgatcctacaacagtgacgcaaaaaggtaaccaaaatgttgaagttaaattgggtgagactacggttagcaaaatatttaatattcaatatttaggtggagttagagataattggggagtaacagctaatggtcgaattgatactttaaataaagtagatgggaaatttagtcattttgcgtacatgaaacctaacaaccagtcgttaagctctgtgacagtaactggtcaagtaactaaaggaaataaaccaggggttaataatccaacagttaaggtatataaacacattggttcagacgatttagctgaaagcgtatatgcaaagcttgatgatgtcagcaaatttgaagatgtgactgataatatgagtttagattttgatactaatggtggttattctttaaactttaataatttagaccaaagtaaaaattatgtaataaaatatgaagggtattatgattcaaatgctagcaacttagaatttcaaacacacctttttggatattataactattattatacaagtaatttaacttggaaaaatggcgttgcattttactctaataacgctcaaggcgacggcaaagataaactaaaggaacctattatagaacatagtactcctatcgaacttgaatttaaatcagagccgccagtggagaagcatgaattgactggtacaatcgaagaaagtaatgattctaagccaattgattttgaatatcatacagctgttgaaggtgcagaaggtcatgcagaaggtaccattgaaactgaagaagattctattcatgtagactttgaagaatcgacacatgaaaattcaaaacatcatgctgatgttgttgaatatgaagaagatacaaacccaggtggtggtcaggttactactgagtctaacctagttgaatttgacgaagattctacaaaaggtattgtaactggtgctgttagcgatcatacaacaattgaagatacgaaagaatatacgactgaaagtaatctgattgaactagtagatgaactacctgaagaacatggtcaagcgcaaggaccaatcgaggaaattactgaaaacaatcatcatatttctcattctggtttaggaactgaaaatggtcacggtaattatggcgtgattgaagaaatcgaagaaaatagccacgtggatattaagagtgaattaggttacgaaggtggccaaaatagcggtaatcagtcatttgaggaagacacagaagaagataaaccgaaatatgaacaaggtggcaatatcgtagatatcgatttcgatagtgtacctcaaattcatggtcaaaataatggtaaccaatcattcgaagaagatacagagaaagacaaacctaagtatgaacaaggtggtaatatcattgatatcgacttcgacagtgtgccacatattcacggattcaataagcacactgaaattattgaagaagatacaaataaagataaaccaaattatcaattcggtggacacaatagtgttgactttgaagaagatacacttccacaagtaagtggtcataatgaaggtcaacaaacgattgaagaagatacaacacctccaatcgtgccaccaacgccaccgacaccagaagtaccaagcgagccggaaacaccaacaccaccgacaccagaagtaccaagcgagccggaaacaccaacaccgccaacgccagaggtaccaactgaacctggtaaaccaataccacctgctaaagaagaacctaaaaaaccttctaaaccagtggaacaaggtaaagtagtaacacctgttattgaaatcaatgaaaaggttaaagcagtggtaccaactaaaaaagcacaatctaagaaatctgaactacctgaaacaggtggagaagaatcaacaaacaacggcatgttgttcggcggattatttagcattttaggtttagcgttattacgcagaaataaaaagaatcacaaagca

SEQ ID NO: 18 - DNA, 3351 bp, Staphylococcus aureus
atgcaaatgagagataagaaaggaccggtaaataaaagagtagattttctatcaaataaattgaataaatattcaataagaaaatttacagttggaacagcatctattttaattggctcactaatgtatttgggaactcaacaagaggcagaagcagctgaaaacaatattgagaatccaactacattaaaagataatgtccaatcaaaagaagtgaagattgaagaagtaacaaacaaagacactgcaccacagggtgtagaagctaaatctgaagtaacttcaaacaaagacacaatcgaacatgaaccatcagtaaaagctgaagatatatcaaaaaaggaggatacaccaaaagaagtagctgatgttgctgaagttcagccgaaatcgtcagtcactcataacgcagagacacctaaggttagaaaagctcgttctgttgatgaaggctcttttgatattacaagagattctaaaaatgtagttgaatctaccccaattacaattcaaggtaaagaacattttgaaggttacggaagtgttgatatacaaaaaaaaccaacagatttaggggtatcagaggtaaccaggtttaatgttggtaatgaaagtaatggtttgataggagctttacaattaaaaaataaaatagattttagtaaggatttcaattttaaagttagagtggcaaataaccatcaatcaaataccacaggtgctgatggttgggggttcttatttagtaaaggaaatgcagaagaatatttaactaatggtggaatccttggggataaaggtctggtaaattcaggcggatttaaaattgatactggatacatttatacaagttccatggacaaaactgaaaagcaagctggacaaggttatagaggatacggagcttttgtgaaaaatgacagttctggtaattcacaaatggttggagaaaatattgataaatcaaaaactaattttttaaactatgcggacaattcaactaatacatcagatggaaagtttcatgggcaacgtttaaatgatgtcatcttaacttatgttgcttcaactggtaaaatgagagcagaatatgctggtaaaacttgggagacttcaataacagatttaggtttatctaaaaatcaggcatataatttcttaattacatctagtcaaagatggggccttaatcaagggataaatgcaaatggctggatgagaactgacttgaaaggttcagagtttacttttacaccagaagcgccaaaaacaataacagaattagaaaaaaaagttgaagagattccattcaagaaagaacgtaaatttaatccggatttagcaccagggacagaaaaagtaacaagagaaggacaaaaaggtgagaagacaataacgacaccaacactaaaaaatccattaactggagtaattattagtaaaggtgaaccaaaagaagagattacaaaagatccgattaatgaattaacagaatacggacctgaaacaatagcgccaggtcatcgagacgaatttgatccgaagttaccaacaggagagaaagaggaagttccaggtaaaccaggaattaagaatccagaaacaggagacgtagttagaccgccggtcgatagcgtaacaaaatatggacctgtaaaaggagactcgattgtagaaaaagaagarattccattcragaaagaacgtaaatttaatccggatttagcaccagggacagaaaaagtaacaagagaaggacaaaaaggtgagaagacaataacgacgccaacactaaaaaatccattaactggagaaattattagtaaaggtgaatcgaaagaagaaatcacaaaagatccgattaatgaattaacagaatacggaccagaaacgataacaccaggtcatcgagacgaatttgatccgaagttaccaacaggagagaaagaggaagttccaggtaaaccaggaattaagaatccagaaacaggagacgtagttagaccaccggtcgatagcgtaacaaaatatggacctgtaaaaggagactcgattgtagaaaaagaagaaattccattcaagaaagaacgtaaatttaatcctgatttagcaccagggacagaaaaagtaacaagagaaggacaaaaaggtgagaagacaataacgacgccaacactaaaaaatccattaactggagaaattattagtaaaggtgaatcgaaagaagaaatcacaaaagatccgattaatgaattaacagaatacggaccagaaacgataacaccaggtcatcgagacgaatttgatccgaagttaccaacaggagagaaagaggaagttccaggtaaaccaggaattaagaatccagaaacaggagatgtagttagaccaccggtcgatagcgtaacaaaatatggacctgtaaaaggagactcgattgtagaaaaagaagaaattccattcgagaaagaacgtaaatttaatcctgatttagcaccagggacagaaaaagtaacaagagaaggacaaaaaggtgagaagacaataacgacgccaacactaaaaaatccattaactggagaaattattagtaaaggtgaatcgaaagaagaaatcacaaaagatccagttaatgaattaacagaattcggtggcgagaaaataccgcaaggtcataaagatatctttgatccaaacttaccaacagatcaaacggaaaaagtaccaggtaaaccaggaatcaagaatccagacacaggaaaagtgatcgaagagccagtggatgatgtgattaaacacggaccaaaaacgggtacaccagaaacaaaaacagtagagataccgtttgaaacaaaacgtgagtttaatccaaaattacaacctggtgaagagcgagtgaaacaagaaggacaaccaggaagtaagacaatcacaacaccaatcacagtgaacccattaacaggtgaaaaagttggcgagggtcaaccaacagaagagatcacaaaacaaccagtagataagattgtagagttcggtggagagaaaccaaaagatccaaaaggacctgaaaacccagagaagccgagcagaccaactcatccaagtggcccagtaaatcctaacaatccaggattatcgaaagacagagcaaaaccaaatggcccagttcattcaatggataaaaatgataaagttaaaaaatctaaaattgctaaagaatcagtagctaatcaagagaaaaaacgagcagaattaccaaaaacaggtttagaaagcacgcaaaaaggtttgatctttagtagtataattggaattgctggattaatgttattggctcgtagaagaaagaat

SEQ ID NO: 19 - DNA, 1308 bp, Staphylococcus aureus
atgaaaaataaatatatctcgaagttgctagttggggcagcaacaattacgttagctacaatgatttcaaatggggaagcaaaagcgagtgaaaacacgcaacaaacttcaactaagcaccaaacaactcaaaacaactacgtaacagatcaacaaaaagctttttatcaagtattacatctaaaaggtatcacagaagaacaacgtaaccaatacatcaaaacattacgcgaacacccagaacgtgcacaagaagtattctctgaatcacttaaagacagcaagaacccagaccgacgtgttgcacaacaaaacgctttttacaatgttcttaaaaatgataacttaactgaacaagaaaaaaataattacattgcacaaattaaagaaaaccctgatagaagccaacaagtttgggtagaatcagtacaatcttctaaagctaaagaacgtcaaaatattgaaaatgcggataaagcaattaaagatttccaagataacaaagcaccacacgataaatcagcagcatatgaagctaactcaaaattacctaaagatttacgtgataaaaacaaccgctttgtagaaaaagtttcaattgaaaaagcaatcgttcgtcatgatgagcgtgtgaaatcagcaaatgatgcaatctcaaaattaaatgaaaaagattcaattgaaaacagacgtttagcacaacgtgaagttaacaaagcacctatggatgtaaaagagcatttacagaaacaattagacgcattagttgctcaaaaagatgctgaaaagaaagtggcgccaaaagttgaggctcctcaaattcaatcaccacaaattgaaaaacctaaagtagaatcaccaaaagttgaagtccctcaaattcaatcaccaaaagttgaggttcctcaatctaaattattaggttactaccaatcattaaaagattcatttaactatggttacaagtatttaacagatacttataaaagctataaagaaaaatatgatacagcaaagtactactataatacgtactataaatacaaaggtgcgattgatcaaacagtattaacagtactaggtagtggttctaaatcttacatccaaccattgaaagttgatgataaaaacggctacttagctaaatcatatgcacaagtaagaaactatgtaactgagtcaatcaatactggtaaagtattatatactttctaccaaaacccaacattagtaaaaacagctattaaagctcaagaaactgcatcatcaatcaaaaatacattaagtaatttattatcattctggaaa

SEQ ID NO: 20 - DNA, 1044 bp, Staphylococcus aureus
atggccgtattttcaaaagagaaaaagagaggatgtatcgttgtgatagaaacatttaaagcgtttgtaattgataaagatgagagtggtaaagtgacaccaactttcaaacaattatcgcctactgatttacctaaaggagatgtgctgattaaagtacattactctggtataaattataaagatgctttagcgactcaagaccataatgcagtcgtaaaatcgtatcctatgattccaggaatagatttagctggaacaattgttgaatccgaagcaccaggctttgaaaaaggagaacaagtaattgtaacgagttatgacctaggtgtcagccattatggcggttttagtgaatatgcgcgtgtaaaatcagaatggattatcaagcttcctgatactttaacattagaagaatcaatgatatatggcacagctggttatactgccggtttagcaattgaaagacttgaaaaagttggaatgaatattgaagatggtcctgtactcgttcgcggtgcttcaggtggtgtcggtactttagcagtactcatgcttaatgaacttggttataaagttatcgcaagtacaggtaaacaagatgttagcgatcaattacttgaacttggtgccaaagaagttatcgatcgacttcctgttgaagatgatcataaaaagccactcgcatcatcaacttggcaagcttgtgtagaccctgttggtggcgaaggtattaattatgttacaaagcgtttaaatcatagtgggtcaattgcagttattggtatgactgccggtaatacttatactaattctgtattccctcacattttaagaggtgtaaacattttaggaattgactcggtatttactgctatgaaattaagacagcgcgtttggcgtcgtctcgcaaaagatttaatgcctgaaaatttacatgagatcaagcaagttattacatttgatgaacttccagaacaacttaacaaagtaattaaacatgaaaataaagggcgcattgttatcgatttcggtgtagataaa

SEQ ID NO: 21 - DNA, 498 bp, Staphylococcus aureus
atgaaaaaattagtaacagcaactacgttaacagcaggaatcggcacagcattagtaggtcaagcatatcatgcagatgctgctgaaaattatacaaattacaacaactataactacaacacgactcaaactacaacgactacgacaactacgacaactacatcatcaatttcacattctggtaacttatacactgcaggacaatgtacttggtatgtatatgataaagttggcggagaaatcggttctacttggggaaatgctaataattgggctgctgctgcacaaggtgctggattcacagtaaatcatacaccttctaaaggcgctatcctacaatcttctgaaggaccatttggtcacgttgcatatgtagaaagtgtaaacagtgatggttcagttacaatttcagaaatgaattatagtggcggacctttctcagtaagttctagaactatttctgcaagtgaagcaggtaactacaactacatccatatt

SEQ ID NO: 22 - DNA, 801 bp, Staphylococcus aureus
atgaagaaaatcgctacagctactatcgcaactgcaggattcgctacaatcgcaattgcatcaggaaatcaagctcatgcttctgagcaagataactacggttataatccaaacgacccaacatcatatagctatacttacactattgatgcacaaggtaactaccattacacatggaaaggtaactggcatccaagtcaattaaaccaagataatggctactacagctattactactacaatggttacaataactataacaattacaacaacggttatagctacaataactacagccgttacaacaactactcaaataataatcaatcatataactacaataactataatagttacaacacaaacagctaccgtactggtggtttaggtgcaagctacagcacttcaagcaacaatgttcaagtaactacaactatggctccatcatcaaatggccgttcaatctcaagtggttatacttcaggacgtaacttatacacttctggtcaatgtacatactacgtatttgatcgtgtaggtggtaaaatcggttcaacttggggcaatgcaagtaactgggctaacgcagctgcaagagctggttacacagtgaacaatacaccaaaagctggtgcaattatgcaaacaactcaaggtgcatacggtcacgttgcatacgttgaaagtgttaacagcaatggttcagtaagagtttcagaaatgaactatggttatggcccaggtgttgtaacttcacgtacaatctcagctagccaagctgctggttataacttcattcac

SEQ ID NO: 23 - DNA, 2427 bp, Staphylococcus aureus
atgtcaatgacatatagaataaagaaatggcaaaaattatccaccattacgttattaatggctggtgtgattactttgaatggtggtgaattcagaagtgttgataaacatcaaatcgctgtggctgatacgaatgttcaaacgccagattatgaaaaattgaggaacacatggctggacgttaactatggttatgataagtatgatgagaataatccagatatgaagaagaagtttgatgctacagagaaagaggcgacgaatttactcaaggaaatgaaaactgaaagtggtaggaaatacttgtggtcaggagcggaaacccttgaaactaattcttctcatatgactcgtacctatcgtaatattgagaaaatcgcagaagcgatgaggaatcctaaaaccactttaaatactgacgaaaataagaagaaagtgaaagatgcccttgagtggctgcataaaaatgcatatggaaaagaaccagataaaaaagtaaaagaattaagtgagaattttactaaaacaactggcaagaataccaacttaaattggtgggattatgaaattggaacacctaaatcattaacaaatacgcttatattgctgaatgatcaattttcaaatgaagaaaagaaaaaattcactgcccctattaaaactttcgccccagatagtgacaaaatattatcttctgtaggaaaagctgaacttgctaaaggcggaaatctagtagacatttctaaggtgaaacttttagaatgtattatcgaagaagataaagatatgatgaaaaagtctatagattcatttaataaagtcttcactwacgttcaagattctgccactggtaaagaacgtaatggattttataaagatggctcttacattgatcatcaagacgttccatacactggtgcttatggcgttgtactcttagaggggatttctcaaatgatgccgatgataaaagaaacaccttttaatgataaaacccaaaatgatacaaccttaaagtcatggattgacgacggatttatgccactcatttataaaggtgaaatgatggatttatcacgaggtagagctatcagtcgtgaaaatgaaaccagtcactcagcatctgcaacagtaatgaaatcattgttgagattaagtgatgccatggatgattcaacaaaagctaagtataaaaagattgtcaaatcttcagtagagtcagattcaagttataaacaaaatgattatttaaattcatattcggacatagataaaatgaagtctttaatgacagataacagtatttctaaaaacggattaacacaacaacttaaaatatataatgacatggatcgtgtcacctatcataacaaagacttagactttgcatttggtttaagtatgacgtcgaaaaacgtagcacgctatgaaagtatcaacggagagaatttaaaaggttggcacactggtgctggaatgtcttatttatataacagcgatgtcaaacactatcatgataacttctgggtgacagccgatatgaaacgtttatcaggtacaacaactttagacaatgaaatattaaaagatacggatgataaaaagtcgagtaaaacttttgttggcggaacaaaagttgatgaccaacatgctagtatcggaatggattttgaaaatcaggacaaaactttaactgccaaaaaatcatatttcatattaaacgataaaattgtcttcttaggaactggcattaaaagtactgattcatcaaagaatccagttacaacgattgaaaatcgcaaagcgaatgggtatacgttatatacagacgataaacaaacaaccaattctgataatcaggaaaacaattcagtctttttagagtccacagataccaaaaagaacatcggttatcattttttaaacaaaccgaaaataactgtaaaaaaagaaagtcatactggtaagtggaaagaaataaataaaagtcaaaaggatacacaaaaaactgatgagtattatgaagtaactcaaaagcattctaattctgacaataaatatggatatgtgttgtatccaggcttatctaaagatgtctttaagacaaaaaaagatgaagtaactgtcgttaagcaagaagatgacttccacgttgtgaaagataatgaatcggtttgggctggtgttaattatagtaatagcactcaaacttttgacattaacaacactaaagtcgaagttaaagccaaaggtatgtttatacttaaaaagaaagatgataacacttatgaatgtagcttctataatcctgaatctacaaattccgcttcagatattgaatctaaaatttcaatgaccggttactctattacaaacaaaaatacgtcgacttctaatgaatccggcgtgcactttgaattaactaaa

SEQ ID NO: 24 - DNA, 237 bp, Staphylococcus aureus
gtgaatgatttgaagcaatttctatatattgcgttagtatgtggtgtgatagcaggtcttggtgctttcttacatataccgcagtatccgagcatgacaattccacgtatagtagctattttaggaattatcagtgctatgttgacttttaaagacaagcaaatcagcgcctcattaaagtttagcgcattgttaattaatgtgctgccattatgcggtacctttgtagcttcaaat

SEQ ID NO: 25 - DNA, 1269 bp, Staphylococcus aureus
gtgtctcgtgaaatgtcatatcattggtttaagaaaatgttactttcaacaagtattttaattttaagtagtagtagtttagggcttgcaacgcacacagttgaagcaaaggataacttaaatggagaaaaaccaactactaatttgaatcataatataacttcaccatcagtaaatagtgaaatgaataataatgagactgggacacctcacgaatcaaatcaaacgggtaatgaaggaacaggttcgaatagtcgtgatgctaatcctgattcgaataatgtgaagccagactcaaacaaccaaaacccaagtacagattcaaaaccagacccaaataaccaaaacccaagtccgaatcctaaaccagatccagataacccgaaaccaaaaccggatccaaaaccagacccagataaaccaaagccaaatccggatccaaaaccagatccagataacccgaaaccaaatccagatccaaaaccagacccagataaaccaaagccaaatccggatccaaaaccagatccagataaaccaaagccaaatccgaatccaaaaccagaccctaataagccaaatcctaacccgtcaccagatcccgatcaacctggggattccaatcattctggtggctcgaaaaatggggggacatggaacccaaatgcttcagatggatctaatcaaggtcaatggcaaccaaatgggaatcaaggaaactcacaaaatcctactggtaatgattttgtatcccaacgatttttagccttggcaaatggggcttacaagtataatccgtatattttaaatcaaattaataagttgggcaaagattatggagaagttactgatgaagacatttataatattattcgaaaacaaaatttcagcggaaatgcatatttaaatggattacaacagcaatcgaattactttagattccaatatttcaatccattgaaatcagaaaggtactatcgtaatttagatgaacaagtactcgcattaattactggtgaaattggatcaatgccagatttgaaaaagcccgaagataagccggattcaaaacaacgctcatttgaaccgcatgaaaaagacgattttacagtagttaaaaaacaagaagataataagaaaagtgcgtcaactgcatatagtaaaagttggctagcaattgtatgttctatgatggtggtattttcaatcatgctattcttatttgtaaagcgaaataaaaagaaaaataaaaacgaatcacagcgacga

SEQ ID NO: 26 - DNA, 1053 bp, Staphylococcus aureus
atgaaaaataaaaaacgtgttttaatagcgtcatcattatcatgtgcaattttattgttatcagcagcaacgactcaagcaaattcagctcataaagactctcaagaccaaaataagaaagaacatgttgataagtctcaacaaaaagacaaacgtaatgttactaataaagataaaaattcaacagcaccggatgatattgggaaaaacggtaaaatcacaaaacgaactgaaacagtatatgatgagaaaacaaatatactccaaaatttacaattcgactttatcgatgatccaacttatgacaagaatgtattacttgttaaaaaacaaggctcaattcattcaaatttaaagtttgaatctcataaagaagaaaaaaattcaaattggttaaagtatccaagtgagtaccatgtagattttcaagtaaaaagaaatcgtaaaactgaaatattagaccaattgccgaaaaataaaatttcaactgcaaaagtagacagtacattttcatatagctcaggtggtaaattcgattcaacaaaaggtattggacgaacttcatcaaatagctactccaaaacgattagttataatcagcaaaattatgacacaattgccagcggtaaaaataataactggcatgtacactggtcagttattgcgaatgacttgaagtatggtggagaagtgaaaaatagaaatgatgaattattattctatagaaatacgagaattgctactgtagaaaaccctgaactaagctttgcttcaaaatatagatacccagcattagtaagaagtggctttaatccagaatttttaacttatttatctaatgaaaagtcaaatgagaaaacgcaatttgaagtaacatacacacgaaatcaagatattttgaaaaacagacctggaatacattatgcacctccaattttagaaaaaaataaagatggtcaaagattaattgtcacttatgaagttgattggaaaaataaaacagttaaagtcgttgataaatattctgatgacaataaaccttataaagaagga

SEQ ID NO: 27 - DNA, 870 bp, Staphylococcus aureus
atgtatacacgtacagctacaacaagtgatagtcaaaaaaatattactcaaagcttacaatttaatttcttaactgaacctaattatgataaagaaacagtatttattaaagcaaaaggtacaattggtagtggtttgagaattttagacccaaatggttattggaatagtacattaagatggcctggatcttattcagtttcaattcaaaatgttgatgacaacaacaatacaaatgtgactgactttgcaccaaaaaatcaggatgaatcaagagaagttaaatatacgtatggttataaaacaggtggagatttttcgattaatcgtggaggcttaactggaaatattacaaaagagagtaattattcagagacgattagttatcaacaaccatcatatcgtacattacttgatcaatctacgtcacataaaggtgtaggttggaaagtagaagcacatttgataaataatatgggacatgaccatacgagacaattaactaatgatagtgataatagaactaaaagtgaaattttttctttaacacgaaatggaaatttatgggcgaaagataatttcacacctaaagacaaaatgcctgtaactgtgtctgaagggtttaatccagaatttttagctgttatgtcacatgataaaaaagacaaaggtaaatcacaatttgttgttcattataaaagatcaatggatgagtttaaaatagattggaatcgccatggtttctggggctattggtctggtgaaaaccatgtagataaaaaagaagaaaaattatcagcattatatgaagttgattggaagacacataatgtgaagtttgtaaaagtacttaatgataatgaaaagaaa

SEQ ID NO: 28 - DNA, 636 bp, Staphylococcus aureus
gtggtgaaatttatgaattatccaaatggtaaaccatatcgtaaaaatagtgctatagacggagggaaaaagaccgctgcctttagtaatattgagtatggtggacgtggtatgtcacttgaaaaagatatcgaacattcaaatacgttttatcttaaaagcgacattgcagttattcacaaaaagcctacgccagtacaaatagttaatgtcaactatcctaagcggagtaaagctgtgattaacgaagcttattttcgtacaccttcaacaactgattacaacggcgtttatcaaggttattatattgattttgaagcaaaggaaactaaaaacaagacgtcctttcctttaaataatattcatgaccatcaagtcgaacatatgaaaaatgcatatcaacaaaaaggtattgtgtttttaatgattcgttttaaaacgctagatgaagtttatcttttaccctattcaaaattcgaagtattttggaagagatataaagataatattaaaragtctataacagttgatgaaatacgaaaaaatggttaccatattccttatcagtatcaaccaagattagactatctaaaagcagttgataagttgatattagatgaaagtgaggaccgcgta

SEQ ID NO: 29 - DNA, 5976 bp, Staphylococcus aureus
gtgaatacaacgaaagcagcattacatggtgatgtgaagttacaaaatgataaagatcatgctaagcaaacggttagtcaattagcacatctaaacaatgcacaaaaacatatggaagatacgttaattgatagtgaaacaactagaacagcagttaagcaagatttgactgaagcacaagcattagatcaacttatggatgcattacaacaaagtattgctgacaaagatgcaacacgtgcgagcagtgcatatgtcaatgcagaaccgaataaaaaacaatcctatgatgaagcagttcaaaatgctgagtctatcattgcaggattaaataatccaactatcaataaaggtaatgtatcaagtgcgactcaagcagtaatatcatctaaaaatgcattagatggtgttgaacgattagctcaagataagcaaactgctggaaattctctaaatcatttagatcaattaacaccagctcaacaacaagcgctagaaaatcaaattaataatgcaacaactcgtggcgaagtagcacaaaaattaactgaagcacaagcacttaaccaagcaatggaagctttacgtaatagcattcaagatcaacagcaaacggaagcgggtagcaagtttatcaatgaagataaaccacaaaaagatgcttaccaagcagcagttcaaaatgcaaaagatttaattaatcaaactaacaatccaacgcttgataaagcacaagttgaacaattgacacaagctgttaaccaagctaaagataacctacacggtgatcaaaaacttgcagacgataaacaacatgcggttactgatttaaatcaattaaatggtttgaataatccgcaacgtcaagcacttgaaagccaaataaacaacgcagcaactcgtggcgaagtagcacaaaaattagctgaagcaaaagcgcttgatcaagcaatgcaagcattacgtaatagtattcaagatcaacaacaaacagaatctggtagcaagtttatcaatgaagataaaccgcaaaaagatgcttaccaagcagcagttcaaaatgcaaaagatttaattaaccaaacaggtaatccaacactcgacaaatcacaagtagaacaattgacacaagcagtaacaactgcaaaagataatctacatggtgatcaaaaacttgctcgtgatcaacaacaagcagtaacaactgtaaatgcattgccaaacttaaatcatgcacaacaacaagcattaactgatgctataaatgcagcgcctacaagaacagaggttgcacaacatgttcaaactgctactgaacttgatcacgcgatggaaacattgaaaaataaagttgatcaagtgaatacagataaggctcaaccaaattacactgaagcgtcaactgataaaaaagaagcagtagatcaagcgttacaagctgcagaaagcattacagatccaactaatggttcaaatgcgaataaagacgctgtagaccaagtattaactaagcttcaagaaaaagaaaatgagttaaatggtaatgagagagtcgctgaagctaaaacacaagcgaaacaaactattgaccaattaacacatttaaatgctgatcaaattgcaactgctaaacaaaacattgatcaagcgacgaaacttcaaccaattgctgaattagtagatcaagcaacgcaattgaatcaatctatggatcaattacaacaagcagttaatgaacatgctaacgttgagcaaactgtagattacacacaagcagattcagataaacaaaatgcttataaacaagctattgctgatgctgaaaatgtattgaaacaaaatgcgaataagcaacaagtggatcaagcacttcaaaatattttaaatgcaaaacaagcattaaatggtgatgaacgtgtagcacttgctaaaacaaatggtaaacatgacatcgaccaattgaatgcattaaacaatgctcaacaagatggatttaaaggtcgcatcgatcaatcaaacgatttaaatcaaatccaacaaattgtagatgaggctaaggcacttaatcgtgcaatggatcaattgtcacaagaaatcactgacaatgaaggacgcacgaaaggtagcacgaactatgtcaatgcagatacacaagtcaaacaagtatatgatgaaacggttgataaagcgaaacaagcacttgataaatcgactggtcaaaacttaactgcaaaacaagttatcaaattaaatgatgcagtcactgcagctaagaaagcattaaatggtgaagaaagacttaataatcgtaaagctgaagcattacaaagattggatcaattaacacatctaaacaatgctcaaagacaattagcaatccaacaaattaataatgctgaaacgctaaataaagcatctcgagcaattaatagagcaactaaattagataatgcaatgggtgcagtacaacaatatattgacgaacagcaccttggtgttatcagcagcacaaattacatcaatgcagatgacaatttgaaagcaaattatgataatgcaattgcgaatgcagcacatgagttagataaagtgcaaggtaatgcaattgcaaaagctgaagcagagcaattgaaacaaaatattatcgatgctcaaaatgcattaaatggagaccaaaaccttgcaaatgccaaagataaagcaaatgcgtttgttaattcgttaaatggattaaatcaacagcaacaagatcttgcacataaagcaattaacaatgccgatactgtatcagatgtaacagatattgttaataatcaaattgacttaaatgatgcaatggaaacattgaaacatttagttgacaatgaaattccaaatgcagagcaaactgtcaattaccaaaacgctgacgataatgctaaaacaaacttcgatgatgccaaacgtctagcaaatacattgctaaatagtgataacacaaatgtgaatgatatcaatggcgcaatccaagcagtcaatgatgcaatccataatcttaatggtgatcaacgactacaagatgctaaagacaaggcaattcaatctattaatcaagctttagctaataagctaaaagaaatcgaagcttcaaatgcgacggatcaagacaagcttattgcgaaaaataaagcagaagaattggcaaacagcatcatcaacaacattaataaagcaacaagtaatcaggctgtatctcaagttcaaacagcaggcaaccacgcgattgaacaagtgcatgccaatgaaataccaaaagcaaaaattgatgccaataaagacgttgataagcaagttcaagcattaattgacgaaattgatcgaaatccaaatctaacagataaggaaaaacaagcacttaaagatcgtattaatcaaatacttcaacaaggtcataacggcattaacaatgcgatgactaaagaagaaattgaacaagccaaagcacaacttgcgcaagcattacaagacatcaaagatttagtgaaagctaaagaagatgcgaaacaagatgttgataaacaagttcaagctttaattgacgaaatcgatcaaaatccaaatctaacagataaggaaaaacaagcacttaaagatcgtattaatcaaatacttcaacaaggtcatarcgacattamcaatgcgatgacaaaagaagcaattgaacaagcaaaagaacgtttagcgcaagcattgcaagacatcaaagatttagtgaaagctaaagaagatgcgaaaaatgatattgataaacgtgtacaagctttaattgacgaaatcgatcaaaatccaaatctaacagataaggaaaaacaagcacttaaagatcgaattaatcaaatacttcaacaaggtcataacgacattaacaatgcgctgactaaagaagaaattgagcaggcaaaagcacaacttgcacaagcattgcaagacatcaaagatttagtgaaagctaaagaagatgcgaaaaatgcaataaaagccttagctaatgcgaagcgtgatcaaatcaattcaaatccagatttaacacctgagcaaaaagcaaaagcgctcaaagaaattgacgaagctgaaaaacgagcactacaaaacgttgagaatgctcaaactatagatcaattaaatcgaggattaaacttaggtttagatgacattagaaatacacatgtatgggaggttgatgaacaacctgctgtaaatgaaatttttgaagcaacacctgagcaaatcctagttaatggtgaactcattgtacatcgtgatgacatcattacagaacaagatattcttgcacacataaacttaattgatcagctttcagcagaagtcatcgatacaccatcaactgcaacgatttctgatagcttaacagcaaaagttgaagttacattgcttgatggatcaaaagtgattgttaatgttcctgtaaaagttgtagaaaaagaattgtcagtagtcaaacaacaggcaattgaatcaatcgaaaatgcggcacaacaaaagattaatgaaatcaataatagtgtgacattaacactggaacaaaaagaagctgcaattgcagaagttaataagcttaaacaacaagcaattgatcatgttaacaatgcacctgatgttcattcagttgaagaaattcaacaacaagaacaagcgcatattgaacaatttaatccagaacaatttacgattgaacaagcaaaatcaaatgcaattaaatcgattgaagatgcaattcaacatatgattgatgaaatcaaagctcgtactgatctaacagataaagagaagcaagaagctattgctaagttaaatcaattaaaagaacaagcaattcaagcgattcaacgtgcgcaaagcatcgatgaaataagtgagcaattggaacaatttaaagctcaaatgaaagcagctaatccaacagcaaaagaactagctaaacgcaagcaagaagctattagtagaattaaagacttttcaaatgaaaaaataaatagtattcgaaatagtgaaattggcacagctgatgaaaaacaagcagcaatgaatcaaattaacgaaattgtgcttgaaacaattagagatattaataatgcgcatacattacagcaagttgaggctgcattgaacaatggtattgctcgaatttcagcagtacaaattgtaacatctgatcgtgctaaacaatcgtcaagtactggaaatgaatctaatagccatttaacaattggttatggaactgcaaatcatccatttaacagttcgactattggacataaaaagaaacttgatgaagatgatgacattgatccacttcatatgcgtcactttagtaataatttcggtaatgttattaaaaacgctattggtgtggtgggtatctctggtttactagctagtttctggttcttcattgccaaacgtcgtcgtaaagaagatgaagaggaagaattagaaataagagataataataaagattcaataaaagagactttagacgatacaaaacatttaccacttttatttgcgaaacgtcgcagaaaagaagatgaagaagatgttactgttgaagaaaaagattcgctaaataatggcgagtcactcgataaagttaaacatacgccgttcttcttaccaaaacgtcgtcgtaaagaagatgaagaagatgtggaagttacaaatgaaaacacagatgaaaaagtgttgaaagataacgaacattcaccactcttattcgcaaaacgacgcaaagataaagaggaagatgttgaaacaacaactagtattgaatctaaagatgaggacgttcctttattattggctaaaaagaaaaatcaaaaagataaccaatccaaagacaaaaagtcagcatcaaaaaatacttctaaaaaggtagcagctaaaaagaagaaaaagaaagctaagaaaaataaaaaa

SEQ ID NO: 30 - DNA, 2520 bp, Staphylococcus aureus
atgaatcaggaagttaaaaacaaaatattttcaatcttaaaaattacgtttgctacagctttatttatttttgtagcaatcacattgtatcgggagttatctggtattaactttaaagatacgttggttgaatttagtaagattaaccgtatgtccttagtgttactatttattggtggtggggcatcgcttgttattctatcaatgtatgatgtgattttatctagagctttaaaaatggatatatccttaggcaaagttttaagagtaagttatatcatcaatgcattgaatgcgattgtaggtttcggtggctttattggtgcaggcgttagagcaatggtttataaaaactatacgcatgataaaaagaaattagttcactttatatccttaatacttatttcaatgttgacaggtttaagcttattatcattgctaattgtattccatgttttcgatgcatctttaatcttagataagattacatgggtaagatgggtattatatgtagtgtcatttttcttaccattattcattatttattcaatggttagaccacccgataaaaacaatcgttttgtaggattgtactgcactttagtgtcgtgtgttgaatggttagcagctgcagttgtattatatttctgtggtgtaattgttgacgctcatgtatcattcatgtcctttattgcaatatttatcattgctgcattatcaggtttagtcagctttattcctggtggtttcggcgctttcgatttagttgtattactaggatttaaaactttaggtgtccctgaggaaaaagtattattaatgctacttctatatcgttttgcgtactattttgtaccggtaattattgcattaattttatcatcatttgaatttggtacatcagctaagaagtacattgagggatctaaatactttattcctgctaaagatgttacgtcatttttaatgtcttatcaaaaggatattattgctaaaattccatcattatcattagcaattttagtattctttacaagtatgatcttttttgtaaataacttaacgattgtttacgatgctttatatgatggaaatcacttaacgtattatattctattggcaattcatactagtgcttgtttattacttttactgaatgtagttggtatttataagcaaagtagacgtgccattatctttgctatgatttcaattttattaatcacagtggcgacattcttcacttacgcttcatatattttaataacatggttagctattatttttgttctgcttattgtagctttccgtagagcacgtaggttgaaacgcccagtaagaatgagaaatatagttgcaatgcttttattcagtttatttattttatatgttaaccatatatttattgctggaacgttatatgcattagatatttatacgattgaaatgcatacatctgtattgcgctattacttctggcttacgattttaatcatcgctatcatcataggtatgattgcatggttgtttgattatcaatttagcaaagtacgtatttcttctaaaattgaagattgcgaggagattattaatcagtacggcggtaattatttgagtcacttgatatatagtggtgacaagcagtttttcactaatgaaaataaaacagcatttttaatgtatcgttataaagcaagttcattagtggttcttggagatccgttaggtgatgaaaatgcctttgatgaattgttagaagcattctataattacgctgagtatttaggctatgatgttatattctatcaagttacagatcaacacatgcctttatatcataatttcggtaaccaatttttcaaattaggtgaagaagcaattattgatttaacgcaattttcaacttcaggtaaaaaacgccgtggatttagagcgactttaaataaattcgatgaacttaatatttcgttcgaaattattgaaccaccgttttcaactgaatttataaatgaacttcaacatgtaagtgatttatggctagataatcgtcaggaaatgcatttctctgttggtgaatttaatgaagaatacttatctaaagcgccaattggtgtaatgcgaaatgaagaaaatgaagtaattgcattttgtagtttaatgccaacatactttaatgatgccatttcagtcgatttaattagatggttgccagagttagatttaccattaatggatggtctatacttgcatatgttactttggagtaaagaacaaggttatacaaaatttaatatgggtatggcaacgttatcgaacgttggtcaattgcattattcatatttaagagaacgacttgcaggccgtgtctttgaacatttcaacggtctatatcgtttccaaggattacgtcgttataaatctaaatataatccgaattgggaaccacgctttttagtttatcgtaaagataattcgctttgggaatcactttctaaagtaatgcgtgtaatacgtcacaaa

SEQ ID NO: 31 - DNA, 3735 bp, Staphylococcus aureus
atggttgcattaacgcttgtaggttcagcagtcactgcacatcaagttcaagcagctgagacgacacaagatcaaactactaataaaaacgttttagatagtaataaagttaaagcaactactgaacaagcaaaagctgaggtaaaaaatccaacgcaaaacatttctggcactcaagtatatcaagaccctgctattgtccaaccaaaaacagcaaataacaaaacaggcaatgctcaagtaagtcaaaaagttgatactgcacaagtaaatggtgacactcgtgctaatcaatcagcgactacaaataatacgcagcctgttgcaaagtcaacaagcactacagcacctaaaactaacactaatgttacaaatgctggttatagtttagttgatgatgaagatgataattcagaaaatcaaattaatccagaattaattaaatcagctgctaaacctgcagctcttgaaacgcaatataaaaccgcagcacctaaagctgcaactacatcagcacctaaagctaaaactgaagcgacacctaaagtaactacttttagcgcttcagcacaaccaagatcagttgctgcaacaccaaaaacgagtttgccaaaatataaaccacaagtaaactcttcaattaacgattacattcgtaaaaataacttaaaagcacctaaaattgaagaagattatacatcttacttccctaaatacgcataccgtaacggcgtaggtcgtcctgaaggtatcgtagttcatgatacagctaatgatcgttcgacgataaatggtgaaattagttatatgaaaaataactatcaaaacgcattcgtacatgcatttgttgatggggatcgtataatcgaaacagcaccaacggattacttatcttggggtgtcggtgcagtcggtaaccctagattcatcaatgttgaaatcgtacacacacacgactatgcttcatttgcacgttcaatgaataactatgctgactatgcagctacacaattacaatattatggtttaaaaccagacagtgctgagtatgatggaaatggtacagtatggactcactacgctgtaagtaaatatttaggtggtactgaccatgccgatccacatggatatttaagaagtcataattatagttatgatcaattatatgacttaattaatgaaaaatatttaataaaaatgggtaaagtggcgccatggggtacgcaatctacaactacccctactacaccatcaaaaccaacaacaccgtcgaaaccatcaactggtaaattaacagttgctgcaaacaatggtgtcgcacaaatcaaaccaacaaatagtggtttatatactactgtatacgacaaaactggtaaagcaactaatgaagttcaaaaaacatttgctgtatctaaaacagctacattaggtaatcaaaaattctatcttgttcaagattacaattctggtaataaatttggttgggttaaagaaggcgatgtggtttacaacacagctaaatcacctgtaaatgtaaatcaatcatattcaatcaaacctggtacgaaactttatacagtaccttggggtacatctaaacaagttgctggtagtgtgtctggctctggaaaccaaacatttaaggcttcaaagcaacaacaaattgataaatcaatttatttatatggctctgtgaatggtaaatctggttgggtaagtaaagcatatttagttgatactgctaaacctacgcctacaccaacacctaagccatcaacacctacaacaaataataaattaacagtttcatcattaaacggtgttgctcaaattaatgctaaaaacaatggcttattcactacagtttatgacaaaactggtaagccaacgaaagaagttcaaaaaacatttgctgtaacaaaagaagcaagtttaggtggaaacaaattctacttagttaaagattacaatagtccaactttaattggttgggttaaacaaggtgacgttatttataacaatgcaaaatcacctgtaaatgtaatgcaaacatatacagtaaaaccaggcactaaattatattcagtaccttggggcacttataaacaagaagctggtgcagtttctggtacaggtaaccaaacttttaaagcgactaagcaacaacaaattgataaatctatctatttatttggaactgtaaatggtaaatctggttgggtaagtaaagcatatttagctgtacctgctgcacctaaaaaagcagtagcacaaccaaaaacagctgtaaaagcttatactgttactaaaccacaaacgactcaaacagttagcaagattgctcaagttaaaccaaacaacactggtattcgtgcttctgtttatgaaaaaacagcgaaaaacggtgcgaaatatgcagaccgtacgttctatgtaacaaaagagcgtgctcatggtaatgaaacgtatgtattattaaacaatacaagccataacatcccattaggttggttcaatgtaaaagacttaaatgttcaaaacttaggcaaagaagttaaaacgactcaaaaatatactgttaataaatcaaataacggcttatcaatggttccttggggtactaaaaaccaagtcattttaacaggcaataacattgctcaaggtacatttaatgcaacgaaacaagtatctgtaggcaaagatgtttatttatacggtactattaataaccgcactggttgggtaaatgcaaaagatttaactgcaccaactgctgtgaaaccaactacatcagctgccaaagattataactacacttatgtaattaaaaatggtaatggttattactatgtaacaccaaattctgatacagctaaatactcattaaaagcatttaatgaacaaccattcgcagttgttaaagaacaagtcattaatggacaaacttggtactatggtaaattatctaacggtaaattagcatggattaaatcaactgatttagctaaagaattaattaagtataatcaaacaggtatggcattaaaccaagttgctcaaatacaagctggtttacaatataaaccacaagtacaacgtgtaccaggtaagtggacaggtgctaactttaatgatgttaagcatgcaatggatacgaagcgtttagctcaagatccagcattaaaatatcaattcttacgcttagaccaaccacaaaatatttctattgataaaattaatcaattcttaaaaggtaaaggtgtattagaaaaccaaggtgctgcatttaacaaagctgctcaaatgtatggcattaatgaagtttatcttatctcacatgccctattagaaacaggtaacggtacttctcaattagcgaaaggtgcagatgtagtgaacaacaaagttgtaactaactcaaacacgaaataccataacgtatttggtattgctgcatatgataacgatcctttacgtgaaggtattaaatatgctaaacaagctggttgggacacagtatcaaaagcaatcgttggtggtgctaaattcatcggcaactcatatgtaaaagctggtcaaaatacactttacaaaatgagatggaatcctgcacatccaggaacacaccaatatgctacagatgtagattgggctaacatcaatgctaaaatcatcaaaggctactatgataaaattggcgaagtcggcaaatacttcgacatcccacaatataaa

SEQ ID NO: 32 - DNA, 1011 bp, Staphylococcus aureus
  misc_feature (761): "n" can be any nucleotide
atgaaaggtaaatttttaaaagttagttctttattcgttgcaactttgacaacagcgacacttgtgagttctccagcagcaaacgcgttatcttcaaaggctatggacaatcatccacaacaaacgcagtcaagcaaacagcaaacacctaagattcaaaaaggcggtaaccttaaaccattagaacaacgtgaacacgcaaatgttatattaccaaataacgatcgtcaccaaatcacagatacaacgaatggtcattatgcacccgtaacttatattcaagttgaagcacctactggtacatttattgcttccggtgtagttgtaggtaaagatactcttttaacraataaacacgtcgtagatgctacgcacggtgatcctcatgctttaaaagcattcccttctgcaattaaccaagacaattatccaaatggtggtttcactgctgaacaaatcactaaatattcagacgaaggtgatttagcaatagttaaattctcccctaatgagcaacacaaacatattggtgaagtagttaaaccagcaacaatgagtaataatgctgacactcaagttaaccaaaatattactgtaacaggatatcctggtgataaacctgtagcaacaatgtgggaaagtaaaggaaaaatcacttacctcaaaggcgaagctatgcaatatgatttaagtacaactggtggtaattcaggttcacctgtatttaatgaaaaaaatgaagtgatcggaattcattgggncggtgtaccaaatgaatttaatggtgcggtatttattaatgaaaatgtacgcaacttcttaaaacaaaatattgaagatatccattttgccacgatgaccaacctaataacccagataatcctgataaccctaacaatcctgataaccctaacaacccagatgaaccaaataaccctgacaaccctaacaaccctgataatccagacaatggcgatamcaataattcagacaatccagatgcagcttaat

SEQ ID NO: 33 - DNA, 1002 bp, Staphylococcus aureus
gtgcaaaaaaaagtaattgcagctattattgggacaagcgcgattagcgctgttgcggcaactcaagcaaatgcggctacaactcacacagtaaaaccgggtgaatcagtgtgggcaatttcaaataagtatgggatttcgattgctaaattaaagtcattaaacaatttaacatctaatctaattttcccaaaccaagtactaaaagtatctggctcaagtaattctacgagtaatagtagccgtccatcaacgaactcaggtggcggatcatactacacagtacaagcaggcgactcattatcattaatcgcatcaaaatatggtacaacttaccaaaacattatgcgacttaatggtttaaataatttctttatttatccaggtcaaaaattaaaagtatcaggtactgctagctcaagtaacgctgcgagcaatagtagccgtccatcaacgaactcaggtggcggatcatactatacagtacaagcaggtgactcattgtcattaattgcatcaaaatatggtacaacttatcaaaaaattatgagcttaaatggcttaaataatttctttatatatccgggtcaaaaattgaaagtaactggtaatgcatctacgaactcaggatctgcaacaacgacaaatagaggttacaatacaccagtattcagtcaccaaaacttatatacatggggtcaatgtacatatcatgtatttaatcgtcgtgctgaaattggtaaaggtattagtacttattggtggaatgctaataactgggataacgcagcggcagcagatggttacactatcgacaatagacctactgtaggttctatcgctcaaacagatgtaggttactatggtcatgttatgtttgtagaacgtgtaaataacgatggtagtattttagtttcagaaatgaactattcagctgcaccaggtattttaacttacagaacggtaccagcttaccaagtaaataattatagatatattcac

SEQ ID NO: 34 - DNA, 2841 bp, Staphylococcus aureus
atgaataataaaaagacagcaacaaatagaaaaggcatgataccaaatcgattaaacaaattttcgataagaaagtattctgtaggtactgcttcaattttagtagggacaacattgatttttgggttaagtggtcatgaagctaaagcggcagaacatacgaatggagaattaaatcaatcaaaaaatgaaacgacagccccaagtgagaataaaacaactaaaaaagttgatagtcgtcaactaaaagacaatacgcaaactgcaactgcagatcagcctaaagtgacaatgagtgatagtgcaacagttaaagaaactagtagtaacatgcaatcaccacaaaacgctacagctaatcaatctactacaaaaactagcaatgtaacaacaaatgataaatcatcaactacatatagtaatgaaactgataaaagtaatttaacacaagcaaaagatgtttcaactacacctaaaacaacgactattaaaccaagaactttaaatcgcatggcagtgaatactgttgcagctccacaacaaggaacaaatgttaatgataaagtacatttttcaaatattgacattgcgattgataaaggacatgttaatcagactactggtaaaactgaattttgggcaacttcaagtgatgttttaaaattaaaagcaaattacacaatcgatgattctgttaaagagggcgatacatttacttttaaatatggtcaatatttccgtccaggatcagtaagattaccttcacaaactcaaaatttatataatgcccaaggtaatattattgcaaaaggtatttatgatagtacaacaaacacaacaacatatacttttacgaactatgtagatcaatatacaaatgttagaggtagctttgaacaagttgcatttgcgaaacgtaaaaatgcaacaactgataaaacagcttataaaatggaagtaactttaggtaatgatacatatagcgaagaaatcattgtcgattatggtaataaaaaagcacaaccgcttatttcaagtacaaactatattaacaatgaagatttatcgcgtaatatgactgcatatgtaaatcaacctaaaaatacatatactaaacaaacgtttgttactaatttaactggatataaatttaatccaaatgcaaaaaacttcaaaatttacgaagtgacagatcaaaatcaatttgtggatagtttcacccctgatacttcaaaacttaaagatgttactgatcaattcgatgttatttatagtaatgataataaaacagctacagtcgatttaatgaaaggccaaacaagcagcaataaacaatacatcattcaacaagttgcttatccagataatagttcaacagataatggaaaaattgattatactttagacactgacaaaactaaatatagttggtcaaatagttattcaaatgtgaatggctcatcaactgctaatggcgaccaaaagaaatataatctaggtgactatgtatgggaagatacaaataaagatggtaaacaagatgccaatgaaaaagggattaaaggtgtttatgtcattcttaaagatagtaacggtaaagaattagatcgtacgacaacagatgaaaatggtaaatatcagttcactggtttaagcaatggaacttatagtgtagagttttcaacaccagccggttatacaccgacaactgcaaatgtaggtacagatgatgctgtagattctgatggactaactacaacaggtgtcattaaagacgctgacaacatgacattagatagtggattctacaaaacaccaaaatatagtttaggtgattatgtttggtacgacagtaataaagatggtaaacaagattcgactgaaaaaggaattaaaggtgttaaagttactttgcaaaacgaaaaaggcgaagtaattggtacaactgaaacagatgaaaatggtaaataccgctttgataatttagatagtggtaaatacaaagttatctttgaaaaacctgctggcttaactcaaacaggtacaaatacaactgaagatgataaagatgccgatggtggcgaagttgatgtaacaattacggatcatgatgatttcacacttgataatggctactacgaagaagaaacatcagatagcgactcagattctgacagcgattcagactcagatagcgactcagattcagatagcgactcagattcagacagcgattcagacagcgactcagactcagatagcgattcagattcagacagcgactcagactcagacagcgattcagactcggatagcgactcagactcagatagcgactcagattcggatagcgactcagactcagatagcgattcagattcagatagcgattcggactcagacagtgattcagattcagactcagatagcgactcagattctgacagcgattcagactcagacagcgactcagactcagacagtgattcagattcagacagcgactcagattcagatagcgactcagactcagatagcgactcagactcagatagcgactcagactcggatagcgattcagattcagacagcgactcagattcagatagcgattcggactcagacaacgactcagattcagatagcgattcagattcagatgcaggtaaacatactccggctaaaccaatgagtacggttaaagatcagcataaaacagctaaagcattaccagaaacaggtagtgaaaataataattcaaataatggcacattattcggtggattattcgcggcattaggatcattattgttattcggtcgtcgtaaaaaacaaaataaa

SEQ ID NO: 35 - DNA, 762 bp, Staphylococcus aureus
atggacataaattcagaagaatacaaacaagaggtacttatcaaagacgttgtcatgcttgctgctcgcatactattagaatctggtgcagaaggtacgcgtgtagaagataccatgacacgtattgcaaaaaaacttggttacagtgaaagtaacagctttgttacaaacactgtcatccagtttacgttacattcggaatcgtttcctagaatatttagaattacctctcgagatacaaacttaataaaaatttctcaagctaataaaatttcgcgtcaaattacaaacaatgaaatttctttagccgaagcaaaaacgcaacttgaaaaaatatatgttgctaagcgtgacagcagtcttccctttaaaggttttgctgcagcaatgattgcaatgagtttcttatatttacaaggtggtagattgattgatgttttaactgcgatattagcaggtagtctaggatacctagtcactgagattttagatcgtaagttacacgcacagtttatcccagaattcattggttcattagttattgggattatcgccgttattggacatacacttattccaacaggtgacttggcaactattatcattgcggcagtcatgcctattgttcctggtgtattaataacaaacgcaatacaagatttatttggtggacacatgttgatgttcacaacgaaatcattagaagcattggttactgcgtttggcatcggtgctggcgttggtagcgtattaattttagta

SEQ ID NO: 36 - DNA, 996 bp, Staphylococcus aureus
gtgattgctataatgaatgtaattatcgatgaaagaaaagagaatgctatgacatttaataaagtattattgagctggatagtcatattgattataacaactagcatatatctattttggcagttgggcgatatcaatgatgtatttaaccagtctattttaatcaatgttagattaccgagattattagaagcattgttgacaggtatgatattaactgttgcaggccttatatttcaaacagttttaaataatgcattggcagatagctttacattaggattggcaagcggcgctacatttggttcaggattagcattatttttaggtttaacaacgttatggattcctgtattttcaataacatttagtttgataacattaataactgtattagtcattacgtcggtattgagccaaggctatccagttagaatcttaatattaagtggtttaatgattggtgcgttattcaattcacttctatattttttgattttattaaaacctcgcaaattaaatacaattgccaattatctgtttggtggttttggtgatgcagaatactcaaatgtatctataatagcaatcacatttatcattgcattgtttggtatatttatcattcttaatcaactaaagttattgcaattaggagaactaaaaagtcagtcactaggcttaaatgttcaattgattacatatatcgcgttatgtatagcttctatgataacggcgataaatgtcgcatatgttggcatcattggattcattggtatggtgataccgcaactcattagaaaatggcagtggaaacaatcattaggaagacaattggctttaaatattgtaactggaggacaaataatggttatggcagattttattggtagccatatattgtcaccagtacaaataccggcaagtattatcattgcattaattggtataccagtgttattttacatgctaatatctcagtcgaaacggttacac

SEQ ID NO: 37 - DNA, 795 bp, Staphylococcus aureus
ttgaaaaaattagcatttgcaataacagcaacatctggtgcagctgcatttttaacgcatcatgatgcacaagcttctacacaacatacagtacaatctggtgaatcattatggagtattgctcaaaaatacaacacttcagtagagagtattaaacaaaataaccaattagataacaacttggtattccctggtcaagttatctcagtaggtggaagtgatgcacaaaatacgtcaaacacttctccacaagctggttcagcatcatctcatactgtacaagctggtgaatcattaaatatcattgctagcagatatggtgtttcagttgatcaattaatggcagccaataacttacgtggttatttaattatgcctaaccaaacattacaaattcctaatggtggatcaggtggtacaacaccaacagctacaacaggtagcaatggcaatgcatcatcttttaatcaccaaaatttatacactgctggtcaatgtacatggtacgtatttgaccgtcgtgctcaagctggtagtccaattagcacatattggtcagacgctaagtattgggctggtaacgcagctaatgatggttaccaagtaaacaacacaccatcagttggttcaattatgcaaagcacacctggtccatatggtcatgttgcttatgttgaacgtgtcaatggtgatggtagtatcttgatttctgaaatgaattacacatatggtccatacaatatgaactaccgtacaattccagcttcagaagtttctagctatgcattcatccat

SEQ ID NO: 38 - DNA, 759 bp, Staphylococcus aureus
atgccagattcaatcacaattatagatgaaaacaaagtgattgatgttgtattaattgcaggtagaattttacttgaatcaggtgctgaaacatatcgagttgaagatacaatgaaccgtatcgcacatagttatggtcttcataatacatatagttttgtcagttcaactgcaattattttttcattaaacgatcgaacaagtacaagattaattcgtgtacaagagcgtacaacagatttagagaaaatcgctttaacgaatagtctttcacgtaaaatatcaaataaagaactcacaattgatgaagctaaatctgaatttattcatttacagcatgcatcattacaatattcttttttaacgaatttctttgcagctgccattgcatgtggcttcttcctatttatgtttggtggtgtcgcatcagattgttggattgcagtcattgctggcggatccgcatttttaacattcagctttgtgcaacgctatatacaaattaaatttttctcagagtttgttgcagccgctgtggtcatatccattgcagccacatttactaaattaggcattgcaaccaatcaagatatcattactatagccagtgtcatgccacttgtccctggtatattaattaccaatgccattcgagatttattagcgggtgaattacttgcaggtatgtctcgcggtgttgaagctgcattaacagcattcgcaatcggtgctggtgtcgcaatcgttttattaatcatt

SEQ ID NO: 39 - DNA, 2529 bp, Staphylococcus aureus
atgggatttttatcaaaaattcttgatggcaataataaagaaattaaacagttaggtaaacttgctgataaagtaatcgctttagaagaaaaaacggcaattttaactgatgaagaaattcgtaataaaacgaaacaattccaaacagaattagctgacattgataatgtcaaaaagcaaaatgattatttagataaaattttaccagaagcatatgcacttgttagagaaggctctaaacgtgtattcaatatgacaccatataaagttcaaattatgggtggtattgcaattcataaaggtgatatcgctgagatgagaacaggtgaaggtaaaacattaacagcgacaatgccaacatacttaaatgcattagctggtagaggtgttcacgttattacagtcaatgaatacttatcaagtgttcaaagtgaagaaatggctgagttatataacttcttaggtttgactgtcggattaaacttaaacagtaagacgacagaagaaaaacgtgaagcatacgcacaagacattacttacagtactaataatgagctaggttttgattacttacgagataacatggtgaattattctgaagatagagtaatgcgtccattacattttgcaatcattgatgaggttgactcaattttaatcgacgaggcacgtacgccattaattatttctggtgaagctgaaaagtcaacgtcactttatacacaagcaaatgtttttgcgaaaatgttaaaacaggacgaagattataaatacgatgaaaaaacgaaagctgtacatttaacagaacaaggtgcggataaagctgaacgtatgttcaaagttgaaaacttatatgatgtacaaaatgttgatgttattagtcatatcaacacagctttacgtgcgcacgttacattacaacgtgacgtagactatatggttgttgatggcgaagtattaattgtcgatcaatttacaggacgtacaatgccaggccgtcgtttctcggaaggtttacaccaagctattgaagcgaaggaaggcgttcaaattcaaaatgaatctaaaactatggcgtctattacattccaaaactatttcagaatgtacaataaacttgcgggtatgacaggtacagctaaaactgaagaagaagaatttagaaatatttataacatgacagtaactcaaattccgacaaataaacctgtgcaacgtaacgataagtctgatttaatttacattagccaaaaaggtaaatttgatgcagtagtagaagatgttgttgaaaaacacaaggcagggcaaccagtgctattaggtactgttgcagttgagacttctgaatatatttcaaatttacttaaaaaacgtggtatccgtcatgatgtgttaaatgcgaaaaatcatgaacgtgaagctgaaattgttgcaggcgctggacaaaaaggtgccgttactattgccactaacatggctggtcgtggtacagatatcaaattaggtgaaggcgtagaggaattaggcggtttagcagtaataggtacagagcgacatgaatctcgtcgtattgatgaccagttacgtggtcgttctggacgtcaaggtgataaaggggatagtcgcttctatttatcattacaagatgaattaatgattcgttttggttctgaacgtttacagaaaatgatgagccgactaggtttagatgactctacaccaattgaatcaaaaatggtatcaagagctgtagaatcagcacaaaaacgtgtagaaggtaataacttcgacgcgcgtaaacgtatcttagaatacgatgaagtattacgtaaacaacgtgaaattatctataacgaaagaaatagtattattgatgaagaagacagctctcaagttgtagatgcaatgctacgttcaacgttacaacgtagtatcaattactatattaatacagcagatgacgagcctgaatatcaaccattcatcgactacattaatgacatcttcttacaagaaggtgacattacagaggatgatatcaaaggtaaagatgctgaagatattttcgaagtcgtttgggctaagattgaagcagcatatcaaagtcaaaaagatatcttagaagaacaaatgaatgagtttgagcgtatgattttacttcgttctattgatagccattggactgatcatatcgacacaatggatcaattacgtcaaggtattcacttacgttcttatgcacaacaaaatccattacgtgactatcaaaatgaaggtcatgaattatttgatatcatgatgcaaaatattgaagaagatacttgtaaattcattttaaaatctgtagtacaagttgaagataatattgaacgtgaaaaaacaacagagtttggtgaagcgaagcacgtttcagctgaagatggtaaagaaaaagtgaaaccgaaaccaatcgttaaaggcgatcaagttggtcgtaacgatgattgtccatgtggtagtggtaaaaaattcaaaaattgccatggaaaa

SEQ ID NO: 40 - DNA, 639 bp, Staphylococcus aureus
gtgagggagagtatgtcgaatcaaaattacgactacaataaaaatgaagatggaagtaagaagaaaatgagtacaacagcgaaagtagttagcattgcgacggtattgctattactcggaggattagtatttgcaatttttgcatatgtagatcattcgaataaagctaaagaacgtatgttgaacgaacaaaagcaggaacaaaaagaaaagcgtcaaaaagaaaatgcagaaaaagagagaaagaaaaagcaacaagaggaaaaagagcagaatgagctagattcacaagcaaaccaatatcagcaattgccacagcagaatcaatatcaatatgtgccacctcagcaacaagcacctacaaagcaacgtcctgctaaagaagagaatgatgataaagcatcaaaggatgagtcgaaagataaggatgacaaagcatctcaagataaatcagatgataatcagaagaaaactgatgataataaacaaccagctcagcctaaaccacagccgcaacaaccaacaccaaagccaaataataatcaacaaaacaatcaatcaaatcagcaagcaaaaccacaagcaccacaacaaaatagccaatcaacaacaaataaacaaaataatgctaatgataag

SEQ ID NO: 41 - DNA, 2799 bp, Staphylococcus aureus
atgaatatgaagaaaaaagaaaaacacgcaattcggaaaaaatcgattggcgtggcttcagtgcttgtaggtacgttaatcggttttggactactcagcagtaaagaagcagatgcaagtgaaaatagtgttacgcaatctgatagcgcaagtaacgaaagcaaaagtaatgattcaagtagcgttagtgctgcacctaaaacagacgacacaaacgtgagtgatactaaaacatcgtcaaacactaataatggcgaaacgagtgtggcgcaaaatccagcacaacaggaaacgacacaatcatcatcaacaaatgcaactacggaagaaacgccggtaactggtgaagctactactacgacaacgaatcaagctaatacaccggcaacaactcaatcaagcaatacaaatgcggaggaattagtgaatcaaacaagtaatgaaacgacttctaatgatactaatacagtatcatctgtaaattcacctcaaaattctacaaatgcggaaaatgtttcaacaacgcaagatacttcaactgaagcaacaccttcaaacaatgaatcagctccacagagtacagatgcaagtaataaagatgtagttaatcaagcggttaatacaagtgcgcctagaatgagagcatttagtttagcggcagtagctgcagatgcaccggcagctggcacagatattacgaatcagttgacgaatgtgacagttggtattgactctggtacgactgtgtatccgcaccaagcaggttatgtcaaactgaattatggtttttcagtgcctaattctgctgttaaaggtgacacattcaaaataactgtacctaaagaattaaacttaaatggtgtaacttcaactgctaaagtgccaccaattatggctggagatcaagtattggcaaatggtgtaatcgatagtgatggtaatgttatttatacatttacagactatgtaaatactaaagatgatgtaaaagcaactttgaccatgcccgcttatattgaccctgaaaatgttaaaaagacaggtaatgtgacattggctactggcataggtagtacaacagcaaacaaaacagtattagtagattatgaaaaatatggtaagttttataacttatctattaaaggtacaattgaccaaatcgataaaacaaataatacgtatcgtcagacaatttatgtcaatccaagtggagataacgttattgcgccggttttaacaggtaatttaaaaccaaatacggatagtaatgcattaatagatcagcaaaatacaagtattaaagtatataaagtagataatgcagctgatttatctgaaagttactttgtgaatccagaaaactttgaggatgtcactaatagtgtgaatattacattcccaaatccaaatcaatataaagtagagtttaatacgcctgatgatcaaattacaacaccgtatatagtagttgttaatggtcatattgatccgaatagcaaaggtgatttagctttacgttcaactttatatgggtataactcgaatataatttggcgctctatgtcatgggacaacgaagtagcatttaataacggatcaggttctggtgacggtatcgataaaccagttgttcctgaacaacctgatgagcctggtgaaattgaaccaattccagaggattcagattctgacccaggttcagattctggcagcgattctaattcagatagcggttcagattcgggtagtgattctacatcagatagtggttcagattcagcgagtgattcagattcagcaagtgattcagactcagcgagtgattcagattcagcaagcgattccgactcagcgagcgattccgactcagacaatgactcggattcagatagcgattctgactcagacagtgactcagattccgacagtgactcagattcagatagcgattctgactcagacagtgactcagattcagatagcgattcagattcagatagcgattcagattccgacagtgattccgactcagacagcgattctgactccgacagtgattccgactcagacagcgattcagattccgacagtgattccgactcagatagcgattccgactcagatagcgactcagattcagacagcgattcagattcagacagcgattcagattcagatagcgattcagattccgacagtgactcagattccgacagtgactcggattcagatagcgattcagattccgacagtgactcagattccgacagtgactcagactcagacagtgattcggattcagcgagtgattcggattcagatagtgattccgactccgacagtgactcggattcagatagcgactcagactcggatagcgactcggattcagatagcgattcggactcagatagcgattcagaatcagacagcgattcagaatcagacagcgattcagattcagacagcgactcagacagtgactcagattcagatagtgactcggattcagcgagtgattcagactcaggtagtgactccgattcatcaagtgattccgactcagaaagtgattcaaatagcgattccgagtcaggttctaacaataatgtagttccgcctaattcacctaaaaatggtactaatgcttctaataaaaatgaggctaaagatagtaaagaaccattaccagatacaggttctgaagatgaagcaaatacgtcactaatttggggattattagcatcaataggttcattactacttttcagaagaaaaaaagaaaataaagataagaaa

SEQ ID NO: 42 - DNA, 966 bp, Staphylococcus aureus
atgaattcaaatcacgctaaagcatcagtgacagagagtgttgacaaaaaatttgtagttccagaatcaggaattaataaaattattccagcttacgatgaatttaagaattcgccaaaagtaaatgttagtaatttaactgacaataaaaactttgtagcttctgaagataaattgaataagattgcagattcatcggcagctagtaaaattgtagataaaaactttgtcgtaccagaatcaaagttaggaaacattgtgccagagtacaaagaaatcaataatcgcgtgaatgtagcaacaaacaatccagcttcacaacaagttgataagcattttgttgctaaaggcccagaagtaaatagatttattacgcaaaacaaagtaaaccaccacttcattactacgcaaacccactacaagaaagttattacttcatacaaatcaacacatgtacataaacatgtaaatcatgcaaaggattctattaataaacactttattgttaaaccatcagaatcgcctagatatacacatccatctcaatctttaattatcaagcatcattttgcagttcctggatatcacgcgcataaatttgttacaccagggcatgctagcattaaaattaatcacttttgtgttgtgccacaaataaatagtttcaaggtaattccaccatatggtcacaattcacatcgtatgcatgtaccaagtttccaaaataacacaacagcaacacatcaaaatgctaaagtaaataaagcatatgactataaatacttctattcttataaagtagttaaaggtgtgaagaaatatttctcattttcacaatcaaatggttataaaattgggaaaccatcattaaatatcaaaaatgtaaattatcaatatgctgttccaagttatagccctacacactacgttcctgaatttaagggtagcttaccagcaccacgagta

SEQ ID NO: 43 - DNA, 1071 bp, Staphylococcus aureus
ttggagcatacaattatgaaaatgagaacaattgctaaaaccagtttagcactagggcttttaacaacaggcgcaattacagtaacgacgcaatcggtcaaagcagaaaaaatacaatcaactaaagttgacaaagtaccaacgcttaaagcagagcgattagcaatgataaacataacagcaggtgcaaattcagcgacaacacaagcagctaacacaagacaagaacgcacgcctaaactcgaaaaggcaccaaatactaatgaggaaaaaacctcagcttccaaaatagaaaaaatatcacaacctaaacaagaagagcagaaaacgcttaatatatcagcaacgccagcgcctaaacaagaacaatcacaaacgacaaccgaatccacaacgccgaaaactaaagtgacaacacctccatcaacaaacacgccacaaccaatgcaatctactaaatcagacacaccacaatctccaaccataaaacaagcacaaacagatatgactcctaaatatgaagatttaagagcgtattatacaaaaccgagttttgaatttgaaaagcagtttggatttatgctcaaaccatggacgacggttaggtttatgaatgttattccaaataggttcatctataaaatagctttagttggaaaagatgagaaaaaatataaagatggaccttacgataatatcgatgtatttatcgttttagaagacaataaatatcaattgaaaaaatattctgtcggtggcatcacgaagactaatagtaaaaaagttaatcacaaagtagaattaagcattactaaaaaagataatcaaggtatgatttcacgcgatgtttcagaatacatgattactaaggaagagatttccttgaaagagcttgattttaaattgagaaaacaacttattgaaaaacataatctttacggtaacatgggttcaggaacaatcgttattaaaatgaaaaacggtgggaaatatacgtttgaattacacaaaaaactgcaagagcatcgtatggcaggcactaatattgataacattgaagtgaatataaaa

SEQ ID NO: 44 - DNA, 2226 bp, Staphylococcus aureus
atgacaacaattaaaacatcaaacttaggattcccaagattaggtagaaaaagagaatggaaaaaagccatcgaaagttattgggcaaagaagatttctaaagaagaattagatcaaacattaactgatctacataaagaaaatttattattacaaaagtactatcacttagatagcatcccagttggtgatttctctttatatgaccatatattagatacgtcattattattcaacatcatccctgaacgtttccaaggaagaactattgatgatgatttattatttgatattgctcgcggtaataaagaccatgttgcaagtgcacttataaaatggtttaacactaactatcattacatcgtacctgaatgggacaatgttgagcctaaagtgagtcgcaatgtattattagatcgctttaaatatgcccaatctttaaacgttaacgctcaccctgtcattgttggtccgattacttttgttaaattatcaaaaggcggtcaccaaacttttgaagaaaaagttaaaacgttattaccactttataaagaagtgtttgaatcattaattgatgcaggtgctgagtacattcaagttgatgagccaatcttagttacagacgacagcgaaagctatgaaaatattacacgtgaagcttatgactatttcgaaaaagctggtgttgctaaaaaattagtcattcaaacatactttgaacgtgcacatcttaaattcttaagttctttacctgttggtggtataggtttagactttgtccatgataatggctataaccttaaacaaattgaagctggagattttgataaatcaaaaacattatacgctggaattattgatggtcgtaatgtatgggcaagtgacattgaagctaaaaaagtcttaatcgataaattgttagcacacactaatgaacttgtcattcaaccatcatcttcattattacatgttccagtatctttagatgatgaaacattagatacaagtgttggagaaggcttaagctttgcaactgaaaaattagacgaattagatgcattgcgtcgcctatttaatcaaaacgatagtgttaaatatgataaattaaaagcacgttatgagcgtttccaaaatcaatcattcaaaaacttagattatgatttcgaaagcgtgcgtacttcaagacaatcaccattcgcgcaacgtattgaacaacaacaaaaacgtttgaacttaccggatttaccaacaacaactattggatcattcccacaaagccgagaagttcgaaaataccgtgcagattggaagaacaaacgcattacagacgaagcatatgaaacattcttaaaaaatgaaattgctcgatggattaaaattcaagaagacattggcttagatgtattagttcacggtgaatttgaacgtaatgacatggttgaattcttcggagaaaaattacaaggtttcttagtaactaaattcggttgggtgcaatcatatggttcacgtgccgtaaaaccaccaatcatttatggtgatgtaaaatggacagcgcctttaactgttgatgaaacagtttatgcacaaagcttaacagataaaccagttaaaggtatgttaactggacctgtaacaattctaaactggtcatttgaacgtgttgatttaccacgtaaagtcgttcaagatcaaattgctttagcaatcaacgaagaagtattagcacttgaagctgcaggaatcaaagttatccaagttgacgaacctgcattacgtgaaggcttaccattacgctctgaatatcacgaacaatatcttaaagatgctgttttatcatttaaacttgcaacgtcttcagttcgtgatgaaactcaaatccatacacatatgtgttattctcaattcggtcaaatcattcatgctattcatgacttagatgctgatgttatttcaattgaaacatctcgtagccatggtgatttaattaaagactttgaagatattaattatgatttaggtattggtctaggtgtatatgatattcatagtccacgtattccaacaaaagaagaaattactacagcaatcaatcgttcactacaacaaatcgaccgctcattattctgggtaaaccctgactgtggtttaaaaacgcgaaaagaagaagaagttaaagatgcattgactgtgcttgtgaatgctgttaaagctaaacgccaagaa

SEQ ID NO: 45 - DNA, 159 bp, Staphylococcus aureus
atgagcgacacatataaaagctacctagtagcagtactatgcttcacagtcttagcaattgtacttatgccgtttctatacttcactacagcatggtcaattgcgggattcgcaagtatcgcaacattcatattttataaagaatacttttatgaagaa

SEQ ID NO: 46 - DNA, 1932 bp, Staphylococcus aureus
atgttaagaggacaagaagaaagaaagtatagtattagaaagtattcaataggcgtggtgtcagtgttagcggctacaatgtttgttgtgtcatcacatgaagcacaagcctcggaaaaaacatcaactaatgcagcggcacaaaaagaaacactaaatcaaccgggagaacaagggaatgcgataacgtcacatcaaatgcagtcaggaaagcaattagacgatatgcataaagagaatggtaaaagtggaacagtgacagaaggtaaagatacgcttcaatcatcgaagcatcaatcaacacaaaatagtaaaacaatcagaacgcaaaatgataatcaagtaaagcaagattctgaacgacaaggttctaaacagtcacaccaaaataatgcgactaataatactgaacgtcaaaatgatcaggttcaaaatacccatcatgctgaacgtaatggatcacaatcgacaacgtcacaatcgaatgatgttgataaatcacaaccatccattccggcacaaaaggtaatacccaatcatgataaagcagcaccaacttcaactacacccccgtctaatgataaaactgcacctaaatcaacaaaagcacaagatgcaaccacggacaaacatccaaatcaacaagatacacatcaacctgcgcatcaaatcatagatgcaaagcaagatgatactgttcgccaaagtgaacagaaaccacaagttggcgatttaagtaaacatatcgatggtcaaaattccccagagaaaccgacagataaaaatactgataataaacaactaatcaaagatgcgcttcaagcgcctaaaacacgttcgactacaaatgcagcagcagatgctaaaaaggttcgaccacttaaagcgaatcaagtacaaccacttaacaaatatccagttgtttttgtacatggatttttaggattagtaggcgataatgcacctgctttatatccaaattattggggtggaaataaatttaaagttatcgaagaattgagaaagcaaggctataatgtacatcaagcaagtgtaagtgcatttggtagtaactatgatcgcgctgtagaactttattattacattaaaggtggtcgcgtagattatggcgcagcacatgcagctaaatacggacatgagcgctatggtaagacttataaaggaatcatgcctaattgggaacctggtaaaaaggtacatcttgtagggcatagtatgggtggtcaaacaattcgtttaatggaagagtttttaagaaatggtaacaaagaagaaattgcctatcataaagcgcatggtggagaaatatcaccattattcactggtggtcataacaatatggttgcatcaatcacaacattagcaacaccacataatggttcacaagcagctgataagtttggaaatacagaagctgttagaaaaatcatgttcgctttaaatcgatttatgggtaacaagtattcgaatatcgatttaggattaacgcaatggggctttaaacaattaccaaatgagagttacattgactatataaaacgcgttagtaaaagcaaaatttggacatcagacgacaatgctgcctatgatttaacgttagatggctctgcaaaattgaacaacatgacaagtatgaatcctaatattacgtatacgacttatacaggtgtatcatctcatactggtccattaggttatgaaaatcctgatttaggtacatttttcttaatggctacaacgagtagaattattggtcatgatgcaagagaagaatggcgtaaaaatgatggtgtcgtaccagtgatttcgtcattacatccgtccaatcaaccatttgttaatgttacgaatgatgaacctgccacacgcagaggtatctggcaagttaaaccaatcatacaaggatgggat

SEQ ID NO: 47 - DNA, 1383 bp, Staphylococcus aureus
atgattcatctcattaaggggaagatgcatcatacagttttgtgtattcatttaaacaaaggggttgctttaatgaatcaatatcattctaatgcacaacaaccaagtgcatggcgtttttttgtctatagtttagtgggcatactatgtttctttattccttttacgattaatggtaacaacactattttcgtcgatcatgttcatctagccattcgctcaatcataggtccacttatgccctatgttgcactgattatgattttaattggtacagcgttaccaatagtgagacgtacttttatgacttcaatcacaaacttggtcattacattatttaaagttgcaggtgcaatgatcggtataatgtatgtatttaaaatcggtccatcaatactatttaaagctaactatggtccgtttttgtttgaaaaattaatgatgccattaagtatcttaattccagtaggtgcaattgcgctttctttattagtgggctatggcttattagaatttgtcggtgtttatatggagcctattatgagacctatttttaaaacaccaggaaaatccgctgtcgatgcagtggcttcgtttgtcggcagttattccttaggattattgattactaatcgtgtctataagcaagggatgtacaacaaacgagaagccacgattattgcgactggcttttcaacagtttcagcaacttttatgattatcgttgctaaaactttaggattaatgccgcattggaatttatacttttggataactttagtcatcacatttgtcgtgactgcaattactgcatggctaccgccaatcagcaatgaatcaacagaatattataacggacaagaaggagaacaagaagttgctattgaaggaagcagactgaaaactgcatatgcagaggcgatgaaacaaaatgcattaacaccatctctcgtgaagaacgtttgggacaatttgaaagacggtttagaaatgactgttggtattttaccttctatattatcgattggttttttaggactgattgtagcgaactatacaccattcattgattggcttggctatatcttctatccatttatttatattttcccaattgctgatcaggctttactagcaaaagcgtcagcgatttctattgtagagatgtttctaccatctttgttagtaactaaagctgcaatgagtactaaatttgtcgtcggtgtagtaagcgtatcagccattatctttttctcagcattagtgccatgtatactagcaactgaaattaaaatacctgtctggaaactcatcatcatttggtttttacgcgtggcgttgtcgctattaatcaccatccccgtcgctttacttatttttgga

SEQ ID NO: 48 - DNA, 900 bp, Staphylococcus aureus
atggttattatgaagaaaacaattttactgacgatgacaactcttactttatttagtatgtcgcctaactcggctcaagcatatacgaatgatagcaaaacattagaagaagcaaagaaagcacacccaaacgcacagttcaaagtgaataaagacaccggcgcgtatacttatacatatgacaaaaacaacacgccaaacaacaatcatcaaaaccagtcacgtacaaacgacaatcatcaacacgcaaatcaacgtgatcttaacaacaatcagtaccattcttcattaagtggtcagtatacgcacattaatgacgcaattgattcacacacaccgcctcaaacgtcaccaagcaatcctttgacaccagcaataccgaatgtcgaagacaatgacgatgaattaaataacgctttttcaaaagataacaaagggcttattacaggcatcgatttagacgaattgtatgacgaattacaaatcgccgaatttaatgacaaagcaaagaccgctgacggtaaacctttagcattaggtaacggtaaaatcattgatcagcctcttatcacaagtaagaacaacttatatactgctggacaatgtacatggtatgtctttgataaacgtgccaaagatggacacacgattagtacattttggggagatgctaaaaactgggcaggccaagcttcaagcaatggcttcaaagtagatagacacccaacacgaggatcaattttacaaacagtaaatggtccatttggtcatgtagcctacgttgaaaaagttaatattgatggaagtattctaatttcagaaatgaactggattggtgaatatatcgtttcatcaagaaccatctctgcttcagaagtttcatcatataattacatccat

SEQ ID NO: 49 - DNA, 933 bp, Staphylococcus aureus
ttggaggtatcgtcaatgaagccttatatacaacttgttgtgttcaagcaatggttacaatacatcttgctcgtaacaaccattgtcatcgcactcgtacttattggtatcggttaccgtgtagcacatgacaacttcaaaataccgattaccattcaagatttagaccaaaccactgcatcaaaatcattcgtcaataaaattaaacaatctgactatgtaactattaaaaaagtcgatgaagatgaaagctatattgaagatgatgttactaaaaaggaagctattttaagtatgcaaattcctaaaggtttctctcaaaaattaaaagagaaccgtttaaaagaaacgatacagttatatggtagagatgactttataggtggtattgctgtagaaattgttagtagttcattatatgagcagcaaattcctaacattatttatgaacaccttgaggatatgaaacagcatcaatccatcgatgctatcaacaagtcctatcataaacatacacctgaatctaaaatcaaatttgtgtcgcttactaaacaagcacaacactctatttcaattagcttaatctttgcggtgattttatttgttagcgctgttcaagtagtacttcattatcgtttaaaccaacaagcagcattgcaacgattatcacaatatcatttaagccgtttcaaactatatagtacttatgtaatgacacatacgattttgttattgttggtactattggcagttagtctatatttgtctcaaccactcagcttaatattttacttaaaatcactgttacttatattgatttatgagataggtatcgtctttatcttattccatattcaaacaataagtcatcgattattcatgacatttatatatgcacttgctatgggtatcgtatacttgattattttcatg

SEQ ID NO: 50 - DNA, 1395 bp, Staphylococcus aureus
atgattgaggtgacagagatgaacttttttgatatccataagattccgaacaaaggcattccattatcggtacaacgtaaattatggcttagaaacttcatgcaagctttcttcgtagtgttctttgtttatatggctatgtatttaattcgaaacaactttaaggcggcacaaccgtttttaaaagaggaaattggattatctacattagaacttggttatatcggattagcatttagtatcacgtacggtttaggaaaaacattacttggatattttgtcgatggacgtaacacaaaacgtattatctcgttcttacttatcttatctgcgattacagttttaattatgggatttgttttaagttactttggttctgtaatgggattattaattgtactttggggacttaacggggtgttccaatcagttggtggacctgcaagttattcaacgatttcaagatgggcgccaagaacgaaacgtggccgatacttaggattctggaatacatcacataatatcggtggtgccatagcaggtggtgttgcactttggggtgctaatgtattcttccatggaaatgttatagggatgttcattttcccatcggtgattgcattacttattggtatcgcaacattatttatcggaaaagatgatccggaagaattaggatggaatcgtgctgaagaaatttgggaagagccggtcgataaagaaaatattgattctcaaggtatgacgaaatgggagatctttaaaaaatatatcctgggaaatcctgttatatggattctatgtgtttcaaacgtctttgtatacattgtacgaatcggtattgataactgggcaccgttatatgtgtcagagcatttacactttagtaaaggcgatgcagttaatacgatattctactttgaaattggtgcattagttgcaagtttattatggggctacgtatcagacttattaaaaggtcgtcgtgcaattgtagctattggctgtatgtttatgattacatttgttgtcttattctacacaaatgctacaagtgtcatgatggttaacatttcattgtttgcattaggtgcgttaatctttggtccgcaattattaattggtgtatcattgactggttttgttcctaaaaatgccatcagtgtagcaaacggaatgacaggttcattcgcgtatctattcggtgactcaatggcgaaagttggtttggcggctattgctgatccaacacgtaacggtttaaacatctttggatatacattaagtggatggacagatgttttcatcgtcttctatgttgcattattcctaggcatgattctattaggaatcgttgctttctatgaagaaaagaaaattagaagtttaaaaatt

SEQ ID NO: 51 - DNA, 837 bp, Staphylococcus aureus
atgacaaagaagaaaaacatattaaaagcaatcggtatttacagttttatagcgatgatgtttgtcatcattttatatccactactgtggacatttggcatttcccttaatccaggtacgaacttgtatggtgccaaaatgataccagacaatgcaacatttaaaaattatgcattcttactattcgatgacagtagtcaatacctgacttggtataaaaatacgcttatcgtagcatctgcaaatgcactgtttagtgtgatatttgtcacgttaacagcatatgctttttctagatatcgctttgttggtcgtaaatacgggctgattacatttttgattttacaaatgttccctgtattaatggcaatggtcgcaatctatattttgctaaatacaattggattattagattctttatttggactaacactggtatatattggtggatcaataccgatgaatgcctttttagtgaaaggttacttcgatacgattccaaaagaacttgatgaatctgccaaaattgatggtgcagggcatatgcgtattttcttacaaattatgcttccattagctaagccgattttagcagttgttgctttgttcaattttatggggccatttatggactttatattacctaaaatactattaagaagtcctgaaaaattcacattagcagttggattgttcaactttattaatgataagtatgcaaataatttcacagtgtttgcagcaggggcaattatgattgcagtacctatagcaatcgtattcttgttcttgcaacgctatttagtatcaggtttaacaacaggtgcgacaaaaggt

SEQ ID NO: 52 - DNA, 897 bp, Staphylococcus aureus
gtgatggaaaatagtacgaccgaagcgcgtaatgaagcgacgatgcatcttgatgaaatgactgtggaagaggctttaattacgatgaataaagaagatcagcaagtcccgttagcagttcgaaaggcaataccacaattgacaaaagtaattaaaaaaacaattgcacagtataaaaagggtggacgattgatttatatcggtgcaggtacaagtggaaggttgggtgtcttagatgcagcggagtgtgtacctacattcaatactgaccctcatgaaattataggtattattgctggtggacaacatgctatgacgatggctgtagaaggtgcggaagatcacaaaaaattagcggaagaagatttgaaaaatatagatttaacatcaaaagatgtcgttataggaattgccgcgagtggcaaaacgccatatgttataggcggtttaacatttgctaacacaatcggtgctacaacagtatctatttcatgcaatgaacatgcagttataagtgaaattgcgcagtatccagtagaagttaaagttggtccagaagtattaactggttcaacacgtttaaagtctggtacagcacaaaagttaattttaaatatgatttcaaccatcacaatggttggtgtcggaaaagtttacgataacctcatgattgatgttaaagcaaccaatcaaaaactgatcgaccgttcagtgcgtattattcaagaaatatgtgctatcacatatgatgaagcaatggcgttatatcaggtatctgagcatgatgtgaaagttgcgacagttatgggtatgtgtggcatttctaaggaagaagcaacaagacggttattaaacaatggtgacattgttaaacgagcaatcagagatagacaacct

SEQ ID NO: 53 - DNA, 1584 bp, Staphylococcus aureus
ttgcaatacataattcgttatattatgatgactttacaaatacatacagggggtattaatttgaaaaagaaaaacatttattcaattcgtaaactaggtgtaggtattgcatctgtaactttaggtacattacttatatctggtggcgtaacacctgctgcaaatgctgcgcaacacgatgaagctcaacaaaatgctttttatcaagtcttaaatatgcctaacttaaatgctgatcaacgcaatggttttatccaaagccttaaagatgatccaagccaaagtgctaacgttttaggtgaagctcaaaaacttaatgactctcaagctccaaaagctgatgcgcaacaaaataacttcaacaaagatcaacaaagcgccttctatgaaatcttgaacatgcctaacttaaacgaagcgcaacgtaacggcttcattcaaagtcttaaagacgacccaagccaaagcactaacgttttaggtgaagctaaaaaattaaacgaatctcaagcaccgaaagctgataacaatttcaacaaagaacaacaaaatgctttctatgaaatcttgaatatgcctaacttaaacgaagaacaacgcaatggtttcatccaaagcttaaaagatgacccaagccaaagtgctaacctattgtcagaagctaaaaagttaaatgaatctcaagcaccgaaagcggataacaaattcaacaaagaacaacaaaatgctttctatgaaatcttacatttacctaacttaaacgaagaacaacgcaatggtttcatccaaagcctaaaagatgacccaagccaaagcgctaaccttttagcagaagctaaaaagctaaatgatgctcaagcaccaaaagctgacaacaaattcaacaaagaacaacaaaatgctttctatgaaattttacatttacctaacttaactgaagaacaacgtaacggcttcatccaaagccttaaagacgatccttcagtgagcaaagaaattttagcagaagctaaaaagctaaacgatgctcaagcaccaaaagaggaagacaataacaagcctggcaaagaagacaataacaagcctggcaaagaagacaacaacaagcctggtaaagaagacaacaacaagcctggcaaagaagacggcaacaagcctggtaaagaagacaacaaaaaacctggtaaagaagatggcaacaagcctggtaaagaagacaacaaaaaacctggtaaagaagacggcaacaagcctggcaaagaagatggcaacaaacctggtaaagaagatggtaacggagtacatgtcgttaaacctggtgatacagtaaatgacattgcaaaagcaaacggcactactgctgacaaaattgctgcagataacaaattagctgataaaaacatgatcaaacctggtcaagaacttgttgttgataagaagcaaccagcaaaccatgcagatgctaacaaagctcaagcattaccagaaactggtgaagaaaatccattcatcggtacaactgtatttggtggattatcattagccttaggtgcagcgttattagctggacgtcgtcgcgaacta

SEQ ID NO: 54 - DNA, 1155 bp, Staphylococcus aureus
ttggataaaaagtctgagaagcggggcattaaaatgacggtacaaagtgcatatatacatattccattttgtgtaagaatatgtacatattgtgatttcaataaatattttatacagaatcaacctgtagatgagtacttagatgcactaatcacagaaatgtctacagcaaaatataggatcttaaagaccatgtatgtaggtggcggcacaccaacggccctttctattaatcagttggaaagattacttaaagcaatacgtgatacgtttacaatcacaggcgagtatacatttgaagcaaatcctgatgagttaactaaagagaaagtccaactattagagaaatatggagtaaaaaggatttcaatgggcgttcaaacattcaagccggagttattgtctgttttaggtagaacgcacaatactgaagatatttacacttcggtgttaaatgctaaaaacgcaggtattaaatcaatcagtttagatttaatgtatcatttaccgaaacagacgattgaagattttgaacaaagtttagatctagctttagatatggatattcaacatatttcgagttacggcttaatacttgaacctaaaacccaattttataatatgtatagaaaaggcttgctcaaacttcctaatgaggatttaggtgctgacatgtatcagttgctgatgtctaagatagaacaatctcctttccatcaatacgaaatatctaattttgcattagatggccatgaatcagaacataataaggtttactggtttaatgaggaatattatggatttggagcaggtgcaagtggttatgtagatggtgtgcgttatacgaatatcaatccagtgaatcattatatcaaagctataaataaagaaagtaaagcaattttagtatcaaataaaccttctttgactgagagaatggaagaagaaatgtttcttgggttgcgtttaaatgaaggtgtgagtagtagtaggttcaaaaagaagtttgaccaatctattgaaagtgtctttggtcaaacaataaataatttaaaagagaaggaattaattgtagaaaagaacgatgtgattgcacttacaaatagagggaaagtcataggtaatgaggtttttgaagctttcctaataaatgat

SEQ ID NO: 55 - protein, 313 aa, Staphylococcus aureus
MRNIENLNPGDSVDHFFLVHKATQGVTAQGKDYMTLHLQDKSGEIEAKFWTATKNDMATIKPEEIVHVKGDIINYRGNKQMKVNQIRLATTEDQLKTEQFVDGAPLSPAEIQEEISHYLLDIENANLQRITRHLLKKYQERFYTYPAASSHHHNFASGLSYHVLTMLRIAKSICDIYPLLNKSLLYSGIILHDIGKVRELSGPVATSYTVEGNLLGHISIASDEVVEAARELNIEGEEIMLLRHMILSHHGKLEYGSPKLPYLKEAEILCYIDNIDARMNMFEKAYKKTDKGQFTDKIFGLENRRFYNPESLD

SEQ ID NO: 56 - protein, 895 aa, Staphylococcus aureus
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 57 - protein, 424 aa, Staphylococcus aureus
MSDFNHTDHSTTNHSQTPRYRRPKFPWFKTVIVALIAGIIGALLVLGIGKVLNSTILNKDGSTVQTTNNKGGNQLDGQSKKFGTVHEMIKSVSPTIVGVINMQKASSVDDLLKGKSSKPSEAGVGSGVIYQINNNSAYIVTNNHVIDGANEIRVQLHNKKQVKAKLVGKDAVTDIAVLKIENTKGIKAIQFANSSKVQTGDSVFAMGNPLGLQFANSVTSGIISASERTIDAETTGGNTKVSVLQTDAAINPGNSGGALVDINGNLVGINSMKIAATQVEGIGFAIPSNEVKVTIEQLVKHGKIDRPSIGIGLINLKDIPEEEREQLHTDREDGIYVAKADSDIDLKKGDIITEIDGKKIKDDVDLRSYLYENKKPGESVTVTVIRDGKTKEVKVKLKQQKEQPKRQSRSERQSPGQGDRDFFR

SEQ ID NO: 58 - protein, 717 aa, Staphylococcus aureus
VNQQQEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPYETKRVLDPTMEPGSPDKVAQKGENGEKTTTTPTTINPLTGEKVGEGEPTTEVTKEPIDEIVNYAPEIIPHGTREEIDPNLPEGETKVIPGKDGLKDPETGEIIEEPQDEVIIHGAKDDSDADSDSDADSDSDADSDSDADSDSDADSDSDSDSDSDSDSDSDADSDSDADSDSDSDSDSDADSDSDADSDSDADSDSDADSDSDSDSDSDADSDSDSDSDSDADSDSDADSDSDADSDSDADSDSDSDSDSDADSDSDSDSDSDSDADSDSDSDSDADSDSDADSDSDADSDSDADSDSDSDSDSDSDSDSDSDSDRDSDADSDSDADSDSDSDSDSDADSDSDSDSDSDADSDSDADSDSDSDADSDSDSDSDSDADSDSDADSDSDADSDSDADSDSDSDSDSDSDSDSDADSDSDADSDSDADRDHNDKTDKPNNKELPDTGNDAQNNGTLFGSLFAALGGLFLVGRRRKNKNNEEK

SEQ ID NO: 59 - protein, 453 aa, Staphylococcus aureus
MKSLKTVIGMNNKEHIKSVILALLVLMSVVLTYMVWNFSPDIANVDNTDSKKSETKPLTTPMTAKMDTTITPFQIIHSKNDHPEGTIATVSNVNKLTKPLKNKEVKSVEHVRRDHNLMIPDLNSDFILFDFTYDLPLSTYLGQVLNMNAKVPNHFNFNRLVIDHDADDNIVLYAISKDRHDYVKLTTTTKNDHFLDALAAVKKDMQPYTDIITNKDTIDRTTHVFAPSKPEKLKTYRMVFNTISVEKMNAILFDDSTIVRSSKSGVTTYNNNTGVANYNDKNEKYHYKNLSEDEASSSKMEETIPGTFDFINGHGGFLNEDFRLFSTNNQSGELTYQRFLNGYPTFNKEGSNQIQVTWGEKGVFDYRRSLLRTDVVLNSEDNKSLPKLESVRSSLANNSDINFEKVTNIAIGYEMQDNSDHNHIEVQINSELVPRWYVEYDGEWYVYNDGRLE

SEQ ID NO: 60 - protein, 2261 aa, Staphylococcus aureus
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDLSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSCSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESNSSSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 61 - protein, 619 aa, Staphylococcus aureus
MPKNKILIYLLSTTLVLPTLVSPTAYADTPQKDTTAKTTSHDSKKSNDDETSKDTTSKDIDKADKNNTSNQDNNDKKFKTIDDSTSDSNNIIDFIYKNLPQTNINQLLTKNKYDDNYSLTTLIQNLFNLNSDISDYEQPRNGEKSTNDSNKNSDNSIKNDTDTQSSKQDKADNQKAPKSNNTKPSTSNKQPNSPKPTQPNQSNSQPASDDKANQKSSSKDNQSMSDSALDSILDQYSEDAKKTQKDYASQSKKDKNEKSNTKNPQLPTQDELKHKSKPAQSFNNDVNQKDTRATSLFETDPSISNNDDSGQFNVVDSKDTRQFVKSIAKDAHRIGQDNDIYASVMIAQAILESDSGRSALAKSPNHNLFGIKGAFEGNSVPFNTLEADGNQLYSINAGFRKYPSTKESLKDYSDLIKNGIDGNRTIYKPTWKSEADSYKDATSHLSKTYATDPNYAKKLNSIIKHYQLTQFDDERMPDLDKYERSIKDYDDSSDEFKPFREVSDSMPYPHGQCTWYVYNRMKQFGTSISGDLGDAHNWNNRAQYRDYQVSHTPKRHAAVVFEAGQFGADQHYGHVAFVEKVNSDGSIVISESNVKGLGIISHRTINAAAAEELSYITGK

SEQ ID NO: 62 - protein, 509 aa, Staphylococcus aureus
MRKFSRYAFTSMAALTLLSTLSPAALAIDSKNKPANSDIKFEVTQKSDAVKALKELPKSENVKNIYQDYAVTDVKTDKKGFTHYTLQPSVDGVHAPDKEVKVHADKSGKVVLINGDTDAKKVKPTNKVTLSKDDAADKAFKAVKIDKNKAKNLKDKVIKENKVEIDGDSNKYVYNVELITVTPEISHWKVKIDAQTGEILEKMNLVKEAAETGKGKGVLGDTKDININSIDGGFSLEDLTHQGKLSAFSFNDQTGQATLITNEDENFVKDEQRAGVDANYYAKQTYDYYKDTFGRESYDNQGSPIVSLTHVNNYGGQDNRNNAAWIGDKMIYGDGDGRTFTSLSGANDVVAHELTHGVTQETANLEYKDQSGALNESFSDVFGYFVDDEDFLMGEDVYTPGKEGDALRSMSNPEQFGQPAHMKDYVFTEKDNGGVHTNSGIPNKAAYNVIQAIGKSKSEQIYYRALTEYLTSNSNFKDCKDALYQAAKDLYDEQTAEQVYEAWNEVGVE

SEQ ID NO: 63 - protein, 913 aa, Staphylococcus aureus
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 64 - protein, 233 aa, Staphylococcus aureus
MKKTIMASSLAVALGVTGYAAGTGHQAHAAEVNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 65 - protein, 261 aa, Staphylococcus aureus
MGGYLIMKKIVTATIATAGLATIAFAGHDAQAAEQNNNGYNSNDAQSYSYTYTIDAQGNYHYTWTGNWNPSQLTQNNTYYYNNYNTYSYNNASYNNYYNHSYQYNNYTNNSQTATNNYYTGGSGASYSTTSNNVHVTTTAAPSSNGRSISNGYASGSNLYTSGQCTYYVFDRVGGKIGSTWGNASNWANAAASSGYTVNNTPKVGAIMQTTQGYYGHVAYVEGVNSNGSVRVSEMNYGHGAGVVTSRTISANQAGSYNFIH

SEQ ID NO: 66 - protein, 802 aa, Staphylococcus aureus
MANTKKTTLDITGMTCAACSNRIEKKLNKLDDVNAQVNLTTEKATVEYNPDQHDVQEFINTIQHLGYGVAVETVELDITGMTCAACSSRIEKVLNKMDGVQNATVNLTTEQAKVDYYPEETDADKLVTRIQKLGYDASIKDNNKDQTSRKAEALQHKLIKLIISAVLSLPLLMLMFVHLFNMHIPALFTNPWFQFILATPVQFIIGWQFYVGAYKNLRNGGANMDVLVAVGTSAAYFYSIYEMVRWLNGSTTQPHLYFETSAVLITLILFGKYLEARAKSQTTNALGELLSLQAKEARILKDGNEVMIPLNEVHVGDTLIVKPGEKIPVDGKIIKGMTAIDESMLTGESIPVEKNVDDTVIGSTMNKNGTITMTATKVGGDTALANIIKVVEEAQSSKAPIQRLADIISGYFVPIVVGIALLTFIVWITLVTPGTFEPALVASISVLVIACPCALGLATPTSIMVGTGRAAENGILFKGGEFVERTHQIDTIVLDKTGTITNGRPVVTDYHGDNQTLQLLATAEKDSEHPLAEAIVNYAKEKQLILTETTTFKAVPGHGIEATIDHHHILVGNRKLMADNDISLPKHISDDLTHYERDGKTAMLIAVNYSLTGIIAVADTVKDHAKDAIKQLHDMGIEVAMLTGDNKNTAQAIAKQVGIDTVIADILPEEKAAQIAKLQQQGKKVAMVGDGVNDAPALVKADIGIAIGTGTEVAIEAADITILGGDLMLIPKAIYASKATIRNIRQNLFWAFGYNIAGIPIAALGLLAPWVAGAAMALSSVSVVTNALRLKKMRLEPRRKDA

SEQ ID NO: 67 - protein, 299 aa, Staphylococcus aureus
MFDSIRETIDYAVENNMSFADIMVKEEMELSGKSRDEVRAQMKQNLDVMRDAVIKGTTGDGVESVTGYTGHDAAKLRDYNETHHALSGYEMIDAVKGAIATNEVNAAMGIICATPTAGSSGTIPGALFKLEKTHDLTEEQMIDFLFTSALFGRVVANNASVAGATGGCQAEVGSASAMAAAAAVAIFGGSPEASGHAMALAISNLLGLVCDPVAGLVEIPCVMRNAIGSGNALISADLALAGIESRIPVDEVIEAMDKVGRNLPASLRETGLGGLAGTPTGEAIKRKIFGTAEDMVKNN

SEQ ID NO: 68 - protein, 1018 aa, Staphylococcus aureus
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNGKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 69 - protein, 948 aa, Staphylococcus aureus
LHLRENIIVKSNLRYGIRKHKLGAASVFLGTMIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKGNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQTIEEDTTPPIVPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 70 - protein, 1117 aa, Staphylococcus aureus
  MOD_RES (566): X = anything
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETIAPGHRDEFDPKLPTGEKEEVPGKPGIKNPETGDVVRPPVDSVTKYGPVKGDSIVEKEEIPFXKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 71 - protein, 436 aa, Staphylococcus aureus [sequence omitted]

SEQ ID NO: 72 - protein, 348 aa, Staphylococcus aureus
MAVFSKEKKRGCIVVIETFKAFVIDKDESGKVTPTFKQLSPTDLPKGDVLIKVHYSGINYKDALATQDHNAVVKSYPMIPGIDLAGTIVESEAPGFEKGEQVIVTSYDLGVSHYGGFSEYARVKSEWIIKLPDTLTLEESMIYGTAGYTAGLAIERLEKVGMNIEDGPVLVRGASGGVGTLAVLMLNELGYKVIASTGKQDVSDQLLELGAKEVIDRLPVEDDHKKPLASSTWQACVDPVGGEGINYVTKRLNHSGSIAVIGMTAGNTYTNSVFPHILRGVNILGIDSVFTAMKLRQRVWRRLAKDLMPENLHEIKQVITFDELPEQLNKVIKHENKGRIVIDFGVDK

SEQ ID NO: 73 - protein, 166 aa, Staphylococcus aureus
MKKLVTATTLTAGIGTALVGQAYHADAAENYTNYNNYNYNTTQTTTTTTTTTTTSSISHSGNLYTAGQCTWYVYDKVGGEIGSTWGNANNWAAAAQGAGFTVNHTPSKGAILQSSEGPFGHVAYVESVNSDGSVTISEMNYSGGPFSVSSRTISASEAGNYNYIHI

SEQ ID NO: 74 - protein, 267 aa, Staphylococcus aureus
MKKIATATIATAGFATIAIASGNQAHASEQDNYGYNPNDPTSYSYTYTIDAQGNYHYTWKGNWHPSQLNQDNGYYSYYYYNGYNNYNNYNNGYSYNNYSRYNNYSNNNQSYNYNNYNSYNTNSYRTGGLGASYSTSSNNVQVTTTMAPSSNGRSISSGYTSGRNLYTSGQCTYYVFDRVGGKIGSTWGNASNWANAAARAGYTVNNTPKAGAIMQTTQGAYGHVAYVESVNSNGSVRVSEMNYGYGPGVVTSRTISASQAAGYNFIH

SEQ ID NO: 75 - protein, 809 aa, Staphylococcus aureus
  MOD_RES (277)..(277): X = anything
MSMTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTXVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 76 - protein, 79 aa, Staphylococcus aureus
MNDLKQFLYIALVCGVIAGLGAFLHIPQYPSMTIPRIVAILGIISAMLTFKDKQISASLKFSALLINVLPLCGTFVASN

SEQ ID NO: 77 - protein, 423 aa, Staphylococcus aureus
VSREMSYHWFKKMLLSTSILILSSSSLGLATHTVEAKDNLNGEKPTTNLNHNITSPSVNSEMNNNETGTPHESNQTGNEGTGSNSRDANPDSNNVKPDSNNQNPSTDSKPDPNNQNPSPNPKPDPDNPKPKPDPKPDPDKPKPNPDPKPDPDNPKPNPDPKPDPDKPKPNPDPKPDPDKPKPNPNPKPDPNKPNPNPSPDPDQPGDSNHSGGSKNGGTWNPNASDGSNQGQWQPNGNQGNSQNPTGNDFVSQRFLALANGAYKYNPYILNQINKLGKDYGEVTDEDIYNIIRKQNFSGNAYLNGLQQQSNYFRFQYFNPLKSERYYRNLDEQVLALITGEIGSMPDLKKPEDKPDSKQRSFEPHEKDDFTVVKKQEDNKKSASTAYSKSWLAIVCSMMVVFSIMLFLFVKRNKKKNKNESQRR

SEQ ID NO: 78 - protein, 351 aa, Staphylococcus aureus
MKNKKRVLIASSLSCAILLLSAATTQANSAHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 79 - protein, 290 aa, Staphylococcus aureus
MYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 80 - protein, 212 aa, Staphylococcus aureus
  MOD_RES (172): X = anything
VVKFMNYPNGKPYRKNSAIDGGKKTAAFSNIEYGGRGMSLEKDIEHSNTFYLKSDIAVIHKKPTPVQIVNVNYPKRSKAVINEAYFRTPSTTDYNGVYQGYYIDFEAKETKNKTSFPLNNIHDHQVEHMKNAYQQKGIVFLMIRFKTLDEVYLLPYSKFEVFWKRYKDNIKXSITVDEIRKNGYHIPYQYQPRLDYLKAVDKLILDESEDRV

SEQ ID NO: 81 - protein, 1992 aa, Staphylococcus aureus
  MOD_RES (1222)..(1225): X = anything
VNTTKAALHGDVKLQNDKDHAKQTVSQLAHLNNAQKHMEDTLIDSETTRTAVKQDLTEAQALDQLMDALQQSIADKDATRASSAYVNAEPNKKQSYDEAVQNAESIIAGLNNPTINKGNVSSATQAVISSKNALDGVERLAQDKQTAGNSLNHLDQLTPAQQQALENQINNATTRGEVAQKLTEAQALNQAMEALRNSIQDQQQTEAGSKFINEDKPQKDAYQAAVQNAKDLINQTNNPTLDKAQVEQLTQAVNQAKDNLHGDQKLADDKQHAVTDLNQLNGLNNPQRQALESQINNAATRGEVAQKLAEAKALDQAMQALRNSIQDQQQTESGSKFINEDKPQKDAYQAAVQNAKDLINQTGNPTLDKSQVEQLTQAVTTAKDNLHGDQKLARDQQQAVTTVNALPNLNHAQQQALTDAINAAPTRTEVAQHVQTATELDHAMETLKNKVDQVNTDKAQPNYTEASTDKKEAVDQALQAAESITDPTNGSNANKDAVDQVLTKLQEKENELNGNERVAEAKTQAKQTIDQLTHLNADQIATAKQNIDQATKLQPIAELVDQATQLNQSMDQLQQAVNEHANVEQTVDYTQADSDKQNAYKQAIADAENVLKQNANKQQVDQALQNILNAKQALNGDERVALAKTNGKHDIDQLNALNNAQQDGFKGRIDQSNDLNQIQQIVDEAKALNRAMDQLSQEITDNEGRTKGSTNYVNADTQVKQVYDETVDKAKQALDKSTGQNLTAKQVIKLNDAVTAAKKALNGEERLNNRKAEALQRLDQLTHLNNAQRQLAIQQINNAETLNKASRAINRATKLDNAMGAVQQYIDEQHLGVISSTNYINADDNLKANYDNAIANAAHELDKVQGNAIAKAEAEQLKQNIIDAQNALNGDQNLANAKDKANAFVNSLNGLNQQQQDLAHKAINNADTVSDVTDIVNNQIDLNDAMETLKHLVDNEIPNAEQTVNYQNADDNAKTNFDDAKRLANTLLNSDNTNVNDINGAIQAVNDAIHNLNGDQRLQDAKDKAIQSINQALANKLKEIEASNATDQDKLIAKNKAEELANSIINNINKATSNQAVSQVQTAGNHAIEQVHANEIPKAKIDANKDVDKQVQALIDEIDRNPNLTDKEKQALKDRINQILQQGHNGINNAMTKEEIEQAKAQLAQALQDIKDLVKAKEDAKQDVDKQVQALIDEIDQNPNLTDKEKQALKDRINQILQQGHXDIXNAMTKEAIEQAKERLAQALQDIKDLVKAKEDAKNDIDKRVQALIDEIDQNPNLTDKEKQALKDRINQILQQGHNDINNALTKEEIEQAKAQLAQALQDIKDLVKAKEDAKNAIKALANAKRDQINSNPDLTPEQKAKALKEIDEAEKRALQNVENAQTIDQLNRGLNLGLDDIRNTHVWEVDEQPAVNEIFEATPEQILVNGELIVHRDDIITEQDILAHINLIDQLSAEVIDTPSTATISDSLTAKVEVTLLDGSKVIVNVPVKVVEKELSVVKQQAIESIENAAQQKINEINNSVTLTLEQKEAAIAEVNKLKQQAIDHVNNAPDVHSVEEIQQQEQAHIEQFNPEQFTIEQAKSNAIKSIEDAIQHMIDEIKARTDLTDKEKQEAIAKLNQLKEQAIQAIQRAQSIDEISEQLEQFKAQMKAANPTAKELAKRKQEAISRIKDFSNEKINSIRNSEIGTADEKQAAMNQINEIVLETIRDINNAHTLQQVEAALNNGIARISAVQIVTSDRAKQSSSTGNESNSHLTIGYGTANHPFNSSTIGHKKKLDEDDDIDPLHMRHFSNNFGNVIKNAIGVVGISGLLASFWFFIAKRRRKEDEEEELEIRDNNKDSIKETLDDTKHLPLLFAKRRRKEDEEDVTVEEKDSLNNGESLDKVKHTPFFLPKRRRKEDEEDVEVTNENTDEKVLKDNEHSPLLFAKRRKDKEEDVETTTSIESKDEDVPLLLAKKKNQKDNQSKDKKSASKNTSKKVAAKKKKKKAKKNKK

SEQ ID NO: 82 - protein, 840 aa, Staphylococcus aureus
MNQEVKNKIFSILKITFATALFIFVAITLYRELSGINFKDTLVEFSKINRMSLVLLFIGGGASLVILSMYDVILSRALKMDISLGKVLRVSYIINALNAIVGFGGFIGAGVRAMVYKNYTHDKKKLVHFISLILISMLTGLSLLSLLIVFHVFDASLILDKITWVRWVLYVVSFFLPLFIIYSMVRPPDKNNRFVGLYCTLVSCVEWLAAAVVLYFCGVIVDAHVSFMSFIAIFIIAALSGLVSFIPGGFGAFDLVVLLGFKTLGVPEEKVLLMLLLYRFAYYFVPVIIALILSSFEFGTSAKKYIEGSKYFIPAKDVTSFLMSYQKDIIAKIPSLSLAILVFFTSMIFFVNNLTIVYDALYDGNHLTYYILLAIHTSACLLLLLNVVGIYKQSRRAIIFAMISILLITVATFFTYASYILITWLAIIFVLLIVAFRRARRLKRPVRMRNIVAMLLFSLFILYVNHIFIAGTLYALDIYTIEMHTSVLRYYFWLTILIIAIIIGMIAWLFDYQFSKVRISSKIEDCEEIINQYGGNYLSHLIYSGDKQFFTNENKTAFLMYRYKASSLVVLGDPLGDENAFDELLEAFYNYAEYLGYDVIFYQVTDQHMPLYHNFGNQFFKLGEEAIIDLTQFSTSGKKRRGFRATLNKFDELNISFEIIEPPFSTEFINELQHVSDLWLDNRQEMHFSVGEFNEEYLSKAPIGVMRNEENEVIAFCSLMPTYFNDAISVDLIRWLPELDLPLMDGLYLHMLLWSKEQGYTKFNMGMATLSNVGQLHYSYLRERLAGRVFEHFNGLYRFQGLRRYKSKYNPNWEPRFLVYRKDNSLWESLSKVMRVIRHK

SEQ ID NO: 83 - protein, 1245 aa, Staphylococcus aureus
MVALTLVGSAVTAHQVQAAETTQDQTTNKNVLDSNKVKATTEQAKAEVKNPTQNISGTQVYQDPAIVQPKTANNKTGNAQVSQKVDTAQVNGDTRANQSATTNNTQPVAKSTSTTAPKTNTNVTNAGYSLVDDEDDNSENQINPELIKSAAKPAALETQYKTAAPKAATTSAPKAKTEATPKVTTFSASAQPRSVAATPKTSLPKYKPQVNSSINDYIRKNNLKAPKIEEDYTSYFPKYAYRNGVGRPEGIVVHDTANDRSTINGEISYMKNNYQNAFVHAFVDGDRIIETAPTDYLSWGVGAVGNPRFINVEIVHTHDYASFARSMNNYADYAATQLQYYGLKPDSAEYDGNGTVWTHYAVSKYLGGTDHADPHGYLRSHNYSYDQLYDLINEKYLIKMGKVAPWGTQSTTTPTTPSKPTTPSKPSTGKLTVAANNGVAQIKPTNSGLYTTVYDKTGKATNEVQKTFAVSKTATLGNQKFYLVQDYNSGNKFGWVKEGDVVYNTAKSPVNVNQSYSIKPGTKLYTVPWGTSKQVAGSVSGSGNQTFKASKQQQIDKSIYLYGSVNGKSGWVSKAYLVDTAKPTPTPTPKPSTPTTNNKLTVSSLNGVAQINAKNNGLFTTVYDKTGKPTKEVQKTFAVTKEASLGGNKFYLVKDYNSPTLIGWVKQGDVIYNNAKSPVNVMQTYTVKPGTKLYSVPWGTYKQEAGAVSGTGNQTFKATKQQQIDKSIYLFGTVNGKSGWVSKAYLAVPAAPKKAVAQPKTAVKAYTVTKPQTTQTVSKIAQVKPNNTGIRASVYEKTAKNGAKYADRTFYVTKERAHGNETYVLLNNTSHNIPLGWFNVKDLNVQNLGKEVKTTQKYTVNKSNNGLSMVPWGTKNQVILTGNNIAQGTFNATKQVSVGKDVYLYGTINNRTGWVNAKDLTAPTAVKPTTSAAKDYNYTYVIKNGNGYYYVTPNSDTAKYSLKAFNEQPFAVVKEQVINGQTWYYGKLSNGKLAWIKSTDLAKELIKYNQTGMALNQVAQIQAGLQYKPQVQRVPGKWTGANFNDVKHAMDTKRLAQDPALKYQFLRLDQPQNISIDKINQFLKGKGVLENQGAAFNKAAQMYGINEVYLISHALLETGNGTSQLAKGADVVNNKVVTNSNTKYHNVFGIAAYDNDPLREGIKYAKQAGWDTVSKAIVGGAKFIGNSYVKAGQNTLYKMRWNPAHPGTHQYATDVDWANINAKIIKGYYDKIGEVGKYFDIPQYK

SEQ ID NO: 84 - protein, 337 aa, Staphylococcus aureus
  MOD_RES (254)..(327): X = anything
MKGKFLKVSSLFVATLTTATLVSSPAANALSSKAMDNHPQQTQSSKQQTPKIQKGGNLKPLEQREHANVILPNNDRHQITDTTNGHYAPVTYIQVEAPTGTFIASGVVVGKDTLLTNKHVVDATHGDPHALKAFPSAINQDNYPNGGFTAEQITKYSDEGDLAIVKFSPNEQHKHIGEVVKPATMSNNADTQVNQNITVTGYPGDKPVATMWESKGKITYLKGEAMQYDLSTTGGNSGSPVFNEKNEVIGIHWXGVPNEFNGAVFINENVRNFLKQNIEDIHFATMTNLITQIILITLTILITLTTQMNQITLTTLTTLIIQTMAIXIIQTIQMQLN

SEQ ID NO: 85 - protein, 334 aa, Staphylococcus aureus
MQKKVIAAIIGTSAISAVAATQANAATTHTVKPGESVWAISNKYGISIAKLKSLNNLTSNLIFPNQVLKVSGSSNSTSNSSRPSTNSGGGSYYTVQAGDSLSLIASKYGTTYQNIMRLNGLNNFFIYPGQKLKVSGTASSSNAASNSSRPSTNSGGGSYYTVQAGDSLSLIASKYGTTYQKIMSLNGLNNFFIYPGQKLKVTGNASTNSGSATTTNRGYNTPVFSHQNLYTWGQCTYHVFNRRAEIGKGISTYWWNANNWDNAAAADGYTIDNRPTVGSIAQTDVGYYGHVMFVERVNNDGSILVSEMNYSAAPGILTYRTVPAYQVNNYRYIH

SEQ ID NO: 86 - protein, 947 aa, Staphylococcus aureus
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 87 - protein, 254 aa, Staphylococcus aureus
MDINSEEYKQEVLIKDVVMLAARILLESGAEGTRVEDTMTRIAKKLGYSESNSFVTNTVIQFTLHSESFPRIFRITSRDTNLIKISQANKISRQITNNEISLAEAKTQLEKIYVAKRDSSLPFKGFAAAMIAMSFLYLQGGRLIDVLTAILAGSLGYLVTEILDRKLHAQFIPEFIGSLVIGIIAVIGHTLIPTGDLATIIIAAVMPIVPGVLITNAIQDLFGGHMLMFTTKSLEALVTAFGIGAGVGSVLILV

SEQ ID NO: 88 - protein, 332 aa, Staphylococcus aureus
VIAIMNVIIDERKENAMTFNKVLLSWIVILIITTSIYLFWQLGDINDVFNQSILINVRLPRLLEALLTGMILTVAGLIFQTVLNNALADSFTLGLASGATFGSGLALFLGLTTLWIPVFSITFSLITLITVLVITSVLSQGYPVRILILSGLMIGALFNSLLYFLILLKPRKLNTIANYLFGGFGDAEYSNVSIIAITFIIALFGIFIILNQLKLLQLGELKSQSLGLNVQLITYIALCIASMITAINVAYVGIIGFIGMVIPQLIRKWQWKQSLGRQLALNIVTGGQIMVMADFIGSHILSPVQIPASIIIALIGIPVLFYMLISQSKRLH

SEQ ID NO: 89 - protein, 265 aa, Staphylococcus aureus
MKKLAFAITATSGAAAFLTHHDAQASTQHTVQSGESLWSIAQKYNTSVESIKQNNQLDNNLVFPGQVISVGGSDAQNTSNTSPQAGSASSHTVQAGESLNIIASRYGVSVDQLMAANNLRGYLIMPNQTLQIPNGGSGGTTPTATTGSNGNASSFNHQNLYTAGQCTWYVFDRRAQAGSPISTYWSDAKYWAGNAANDGYQVNNTPSVGSIMQSTPGPYGHVAYVERVNGDGSILISEMNYTYGPYNMNYRTIPASEVSSYAFIH

SEQ ID NO: 90 - protein, 253 aa, Staphylococcus aureus
MPDSITIIDENKVIDVVLIAGRILLESGAETYRVEDTMNRIAHSYGLHNTYSFVSSTAIIFSLNDRTSTRLIRVQERTTDLEKIALTNSLSRKISNKELTIDEAKSEFIHLQHASLQYSFLTNFFAAAIACGFFLFMFGGVASDCWIAVIAGGSAFLTFSFVQRYIQIKFFSEFVAAAVVISIAATFTKLGIATNQDIITIASVMPLVPGILITNAIRDLLAGELLAGMSRGVEAALTAFAIGAGVAIVLLII

SEQ ID NO: 91 - protein, 843 aa, Staphylococcus aureus
MGFLSKILDGNNKEIKQLGKLADKVIALEEKTAILTDEEIRNKTKQFQTELADIDNVKKQNDYLDKILPEAYALVREGSKRVFNMTPYKVQIMGGIAIHKGDIAEMRTGEGKTLTATMPTYLNALAGRGVHVITVNEYLSSVQSEEMAELYNFLGLTVGLNLNSKTTEEKREAYAQDITYSTNNELGFDYLRDNMVNYSEDRVMRPLHFAIIDEVDSILIDEARTPLIISGEAEKSTSLYTQANVFAKMLKQDEDYKYDEKTKAVHLTEQGADKAERMFKVENLYDVQNVDVISHINTALRAHVTLQRDVDYMVVDGEVLIVDQFTGRTMPGRRFSEGLHQAIEAKEGVQIQNESKTMASITFQNYFRMYNKLAGMTGTAKTEEEEFRNIYNMTVTQIPTNKPVQRNDKSDLIYISQKGKFDAVVEDVVEKHKAGQPVLLGTVAVETSEYISNLLKKRGIRHDVLNAKNHEREAEIVAGAGQKGAVTIATNMAGRGTDIKLGEGVEELGGLAVIGTERHESRRIDDQLRGRSGRQGDKGDSRFYLSLQDELMIRFGSERLQKMMSRLGLDDSTPIESKMVSRAVESAQKRVEGNNFDARKRILEYDEVLRKQREIIYNERNSIIDEEDSSQVVDAMLRSTLQRSINYYINTADDEPEYQPFIDYINDIFLQEGDITEDDIKGKDAEDIFEVVWAKIEAAYQSQKDILEEQMNEFERMILLRSIDSHWTDHIDTMDQLRQGIHLRSYAQQNPLRDYQNEGHELFDIMMQNIEEDTCKFILKSVVQVEDNIEREKTTEFGEAKHVSAEDGKEKVKPKPIVKGDQVGRNDDCPCGSGKKFKNCHGK

SEQ ID NO: 92 - protein, 213 aa, Staphylococcus aureus
MRESMSNQNYDYNKNEDGSKKKMSTTAKVVSIATVLLLLGGLVFAIFAYVDHSNKAKERMLNEQKQEQKEKRQKENAEKERKKKQQEEKEQNELDSQANQYQQLPQQNQYQYVPPQQQAPTKQRPAKEENDDKASKDESKDKDDKASQDKSDDNQKKTDDNKQPAQPKPQPQQPTPKPNNNQQNNQSNQQAKPQAPQQNSQSTTNKQNNANDK

SEQ ID NO: 93 - protein, 933 aa, Staphylococcus aureus
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 94 - protein, 322 aa, Staphylococcus aureus
MNSNHAKASVTESVDKKFVVPESGINKIIPAYDEFKNSPKVNVSNLTDNKNFVASEDKLNKIADSSAASKIVDKNFVVPESKLGNIVPEYKEINNRVNVATNNPASQQVDKHFVAKGPEVNRFITQNKVNHHFITTQTHYKKVITSYKSTHVHKHVNHAKDSINKHFIVKPSESPRYTHPSQSLIIKHHFAVPGYHAHKFVTPGHASIKINHFCVVPQINSFKVIPPYGHNSHRMHVPSFQNNTTATHQNAKVNKAYDYKYFYSYKVVKGVKKYFSFSQSNGYKIGKPSLNIKNVNYQYAVPSYSPTHYVPEFKGSLPAPRV

SEQ ID NO: 95 - protein, 357 aa, Staphylococcus aureus
LEHTIMKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTPKTKVTTPPSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMAGTNIDNIEVNIK

SEQ ID NO: 96 - protein, 742 aa, Staphylococcus aureus
MTTIKTSNLGFPRLGRKREWKKAIESYWAKKISKEELDQTLTDLHKENLLLQKYYHLDSIPVGDFSLYDHILDTSLLFNIIPERFQGRTIDDDLLFDIARGNKDHVASALIKWFNTNYHYIVPEWDNVEPKVSRNVLLDRFKYAQSLNVNAHPVIVGPITFVKLSKGGHQTFEEKVKTLLPLYKEVFESLIDAGAEYIQVDEPILVTDDSESYENITREAYDYFEKAGVAKKLVIQTYFERAHLKFLSSLPVGGIGLDFVHDNGYNLKQIEAGDFDKSKTLYAGIIDGRNVWASDIEAKKVLIDKLLAHTNELVIQPSSSLLHVPVSLDDETLDTSVGEGLSFATEKLDELDALRRLFNQNDSVKYDKLKARYERFQNQSFKNLDYDFESVRTSRQSPFAQRIEQQQKRLNLPDLPTTTIGSFPQSREVRKYRADWKNKRITDEAYETFLKNEIARWIKIQEDIGLDVLVHGEFERNDMVEFFGEKLQGFLVTKFGWVQSYGSRAVKPPIIYGDVKWTAPLTVDETVYAQSLTDKPVKGMLTGPVTILNWSFERVDLPRKVVQDQIALAINEEVLALEAAGIKVIQVDEPALREGLPLRSEYHEQYLKDAVLSFKLATSSVRDETQIHTHMCYSQFGQIIHAIHDLDADVISIETSRSHGDLIKDFEDINYDLGIGLGVYDIHSPRIPTKEEITTAINRSLQQIDRSLFWVNPDCGLKTRKEEEVKDALTVLVNAVKAKRQE

SEQ ID NO: 97 - protein, 53 aa, Staphylococcus aureus
MSDTYKSYLVAVLCFTVLAIVLMPFLYFTTAWSIAGFASIATFIFYKEYFYEE

SEQ ID NO: 98 - protein, 644 aa, Staphylococcus aureus
MLRGQEERKYSIRKYSIGVVSVLAATMFVVSSHEAQASEKTSTNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMATTSRIIGHDAREEWRKNDGVVPVISSLHPSNQPFVNVTNDEPATRRGIWQVKPIIQGWD

SEQ ID NO: 99 - protein, 461 aa, Staphylococcus aureus
MIHLIKGKMHHTVLCIHLNKGVALMNQYHSNAQQPSAWRFFVYSLVGILCFFIPFTINGNNTIFVDHVHLAIRSIIGPLMPYVALIMILIGTALPIVRRTFMTSITNLVITLFKVAGAMIGIMYVFKIGPSILFKANYGPFLFEKLMMPLSILIPVGAIALSLLVGYGLLEFVGVYMEPIMRPIFKTPGKSAVDAVASFVGSYSLGLLITNRVYKQGMYNKREATIIATGFSTVSATFMIIVAKTLGLMPHWNLYFWITLVITFVVTAITAWLPPISNESTEYYNGQEGEQEVAIEGSRLKTAYAEAMKQNALTPSLVKNVWDNLKDGLEMTVGILPSILSIGFLGLIVANYTPFIDWLGYIFYPFIYIFPIADQALLAKASAISIVEMFLPSLLVTKAAMSTKFVVGVVSVSAIIFFSALVPCILATEIKIPVWKLIIIWFLRVALSLLITIPVALLIFG

SEQ ID NO: 100 - protein, 300 aa, Staphylococcus aureus
MVIMKKTILLTMTTLTLFSMSPNSAQAYTNDSKTLEEAKKAHPNAQFKVNKDTGAYTYTYDKNNTPNNNHQNQSRTNDNHQHANQRDLNNNQYHSSLSGQYTHINDAIDSHTPPQTSPSNPLTPAIPNVEDNDDELNNAFSKDNKGLITGIDLDELYDELQIAEFNDKAKTADGKPLALGNGKIIDQPLITSKNNLYTAGQCTWYVFDKRAKDGHTISTFWGDAKNWAGQASSNGFKVDRHPTRGSILQTVNGPFGHVAYVEKVNIDGSILISEMNWIGEYIVSSRTISASEVSSYNYIH

SEQ ID NO: 101 - protein, 311 aa, Staphylococcus aureus
MEVSSMKPYIQLVVFKQWLQYILLVTTIVIALVLIGIGYRVAHDNFKIPITIQDLDQTTASKSFVNKIKQSDYVTIKKVDEDESYIEDDVTKKEAILSMQIPKGFSQKLKENRLKETIQLYGRDDFIGGIAVEIVSSSLYEQQIPNIIYEHLEDMKQHQSIDAINKSYHKHTPESKIKFVSLTKQAQHSISISLIFAVILFVSAVQVVLHYRLNQQAALQRLSQYHLSRFKLYSTYVMTHTILLLLVLLAVSLYLSQPLSLIFYLKSLLLILIYEIGIVFILFHIQTISHRLFMTFIYALAMGIVYLIIFM

SEQ ID NO: 102 - protein, 465 aa, Staphylococcus aureus
MIEVTEMNFFDIHKIPNKGIPLSVQRKLWLRNFMQAFFVVFFVYMAMYLIRNNFKAAQPFLKEEIGLSTLELGYIGLAFSITYGLGKTLLGYFVDGRNTKRIISFLLILSAITVLIMGFVLSYFGSVMGLLIVLWGLNGVFQSVGGPASYSTISRWAPRTKRGRYLGFWNTSHNIGGAIAGGVALWGANVFFHGNVIGMFIFPSVIALLIGIATLFIGKDDPEELGWNRAEEIWEEPVDKENIDSQGMTKWEIFKKYILGNPVIWILCVSNVFVYIVRIGIDNWAPLYVSEHLHFSKGDAVNTIFYFEIGALVASLLWGYVSDLLKGRRAIVAIGCMFMITFVVLFYTNATSVMMVNISLFALGALIFGPQLLIGVSLTGFVPKNAISVANGMTGSFAYLFGDSMAKVGLAAIADPTRNGLNIFGYTLSGWTDVFIVFYVALFLGMILLGIVAFYEEKKIRSLKI

SEQ ID NO: 103 - protein, 279 aa, Staphylococcus aureus
MTKKKNILKAIGIYSFIAMMFVIILYPLLWTFGISLNPGTNLYGAKMIPDNATFKNYAFLLFDDSSQYLTWYKNTLIVASANALFSVIFVTLTAYAFSRYRFVGRKYGLITFLILQMFPVLMAMVAIYILLNTIGLLDSLFGLTLVYIGGSIPMNAFLVKGYFDTIPKELDESAKIDGAGHMRIFLQIMLPLAKPILAVVALFNFMGPFMDFILPKILLRSPEKFTLAVGLFNFINDKYANNFTVFAAGAIMIAVPIAIVFLFLQRYLVSGLTTGATKG

SEQ ID NO: 104 - protein, 299 aa, Staphylococcus aureus
MMENSTTEARNEATMHLDEMTVEEALITMNKEDQQVPLAVRKAIPQLTKVIKKTIAQYKKGGRLIYIGAGTSGRLGVLDAAECVPTFNTDPHEIIGIIAGGQHAMTMAVEGAEDHKKLAEEDLKNIDLTSKDVVIGIAASGKTPYVIGGLTFANTIGATTVSISCNEHAVISEIAQYPVEVKVGPEVLTGSTRLKSGTAQKLILNMISTITMVGVGKVYDNLMIDVKATNQKLIDRSVRIIQEICAITYDEAMALYQVSEHDVKVATVMGMCGISKEEATRRLLNNGDIVKRAIRDRQP

SEQ ID NO: 105 - protein, 528 aa, Staphylococcus aureus
LQYIIRYIMMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 106 - protein, 385 aa, Staphylococcus aureus
MDKKSEKRGIKMTVQSAYIHIPFCVRICTYCDFNKYFIQNQPVDEYLDALITEMSTAKYRILKTMYVGGGTPTALSINQLERLLKAIRDTFTITGEYTFEANPDELTKEKVQLLEKYGVKRISMGVQTFKPELLSVLGRTHNTEDIYTSVLNAKNAGIKSISLDLMYHLPKQTIEDFEQSLDLALDMDIQHISSYGLILEPKTQFYNMYRKGLLKLPNEDLGADMYQLLMSKIEQSPFHQYEISNFALDGHESEHNKVYWFNEEYYGFGAGASGYVDGVRYTNINPVNHYIKAINKESKAILVSNKPSLTERMEEEMFLGLRLNEGVSSSRFKKKFDQSIESVFGQTINNLKEKELIVEKNDVIALTNRGKVIGNEVFEAFLIND

SEQ ID NO: 107 - DNA, 1245 bp, Staphylococcus aureus
atgaatgtattagtaattggtgctggtggacgagaacatgcacttgcatataaacttaatcaatcgaatctagttaaacaagtgtttgtcattccaggtaatgaggcaatgacacctatagctgaagtacacactgaaatttcagaacctgatcatcaagcgatactagattttgctaaacggcaaaatgttgattgggtagttataggtccagaacagccgctaattgatggattagcagacattttacgagcgaatggtttcaaagtgtttggtccaaataagcaagcagctcaaatcgaaggctcaaaattatttgctaaaaagataatggaaaaatataatattccaactgctgattataaagaagttgagcgaaaaaaggatgctttaacatatattgaaaactgtgaattgcccgttgttgtcaagaaagatgggttagctgctgggaaaggcgttattattgcagatactattgaagcagccagaagtgctattgagattatgtatggtgatgaagaagaaggtactgttgtatttgaaacgtttttagaaggtgaagagttctcgctaatgacatttgttaatggtgatttagcagtacctttcgactgtattgcacaagatcataaacgcgcatttgatcatgatgaaggaccaaatactggtggtatgggggcttattgtccagtaccacatattagtgacgatgttttaaaacttacaaatgaaacaattgcacaacccattgcaaaggcaatgcttaatgaaggttatcaattcttcggtgtattatacattggtgctattttaactaaagatggtccaaaagtaatagaatttaatgcccgttttggtgatcctgaagctcaagtattattaagtcgcatggaaagtgatttaatgcagcatattattgatttagatgaaggaaaacgtactgaattcaaatggaaaaatgaatctattgtaggggtcatgttggcatcaaaaggatatcctgatgcatatgaaaaagggcataaagtaagtggctttgatttaaatgaaaactattttgttagtggattaaagaagcaaggtgatacctttgttacttcaggtggtagagttatacttgccatcggaaaaggtgacaatgtacaagatgcacagcgagacgcatacaaaaaagtatcacaaatacaaagtgaccatttattctatcgtcatgacattgcgaataaagcactacaacttaaa

SEQ ID NO: 108 - protein, 415 aa, Staphylococcus aureus
MNVLVIGAGGREHALAYKLNQSNLVKQVFVIPGNEAMTPIAEVHTEISEPDHQAILDFAKRQNVDWVVIGPEQPLIDGLADILRANGFKVFGPNKQAAQIEGSKLFAKKIMEKYNIPTADYKEVERKKDALTYIENCELPVVVKKDGLAAGKGVIIADTIEAARSAIEIMYGDEEEGTVVFETFLEGEEFSLMTFVNGDLAVPFDCIAQDHKRAFDHDEGPNTGGMGAYCPVPHISDDVLKLTNETIAQPIAKAMLNEGYQFFGVLYIGAILTKDGPKVIEFNARFGDPEAQVLLSRMESDLMQHIIDLDEGKRTEFKWKNESIVGVMLASKGYPDAYEKGHKVSGFDLNENYFVSGLKKQGDTFVTSGGRVILAIGKGDNVQDAQRDAYKKVSQIQSDHLFYRHDIANKALQLK

SEQ ID NO: 109 - DNA, 822 bp, Staphylococcus aureus
atgcaaccacatttaatatgtctagacttagacggaacattattaaacgataacaaagaaatttcatcatatactaaacaagtattaaatgaattacaacaacgtggacaccaaattatgattgcgactggcagaccttatcgtgcaagtcaaatgtattatcatgaattaaatttaacgacaccaattgttaattttaatggcgcttacgtacatcaccctaaagataaaaacttcaaaacttgccatgaaattttagatttaggcatcgcacaaaacattattcaaggattacaacaatatcaagtatcgaatattatagcagaagtgaaagattatgttttcattaacaatcatgatccaagattatttgaaggtttttcaatgggtaatccaagaattcaaactggtaatttacttgtccacttgaaagaatcccctacctcaattttaattgaagccgaagaaagtaaaatacctgaaatcaaaaatatgcttactcatttttatgccgatcatattgagcatcgacgctggggcgcaccattccctgtcattgaaattgtaaaacttggtattaataaagcaagaggcattgagcaagttagacaatttttaaatattgaccgaaataatattattgcattcggtgatgaagataatgatattgaaatgattgagtacgcgcgtcacggtgttgctatggaaaatggtttgcaagaacttaaagatgtagcgaacaatattacattcaacaataatgaagatggcattggtcgatatttgaatgatttctttaatttaaatattagatattactgt

SEQ ID NO: 110 - protein, 274 aa, Staphylococcus aureus
MQPHLICLDLDGTLLNDNKEISSYTKQVLNELQQRGHQIMIATGRPYRASQMYYHELNLTTPIVNFNGAYVHHPKDKNFKTCHEILDLGIAQNIIQGLQQYQVSNIIAEVKDYVFINNHDPRLFEGFSMGNPRIQTGNLLVHLKESPTSILIEAEESKIPEIKNMLTHFYADHIEHRRWGAPFPVIEIVKLGINKARGIEQVRQFLNIDRNNIIAFGDEDNDIEMIEYARHGVAMENGLQELKDVANNITFNNNEDGIGRYLNDFFNLNIRYYC

SEQ ID NO: 111 - DNA, 1503 bp, Staphylococcus aureus
gtgaaaccaatggctaagtctaatagtaaagacatcgttttaattggagccggtgtacttagcacaacatttggttcaatgttaaaagaaattgagccagactggaatatccacgtttacgaacgcttggatcgtcctgcaatcgaaagttcaaacgaaagaaataatgctggtacgggtcatgcagcattatgtgagttgaactacacagttttacaacctgatggttctatcgacatcgaaaaagcgaaagtgattaacgaagagtttgagatttcaaaacaattctggggtcacttagtgaaaagcggtagcatcgagaacccaagagaatttatcaatccattaccacacatcagttatgttagaggtaaaaacaatgttaaattcttaaaagatcgttacgaagcgatgaaagctttccctatgttcgataatatcgaatatactgaagacatcgaagtaatgaaaaaatggattccattgatgatgaaaggccgtgaagataaccctggtatcatggcggcaagtaaaattgacgaaggtacagatgtaaacttcggtgaattaacacgtaaaatggctaaaagcattgaagcacatccaaatgctacagtgcaatttaaccatgaagttgttgattttgaacaattatcaaatggtcaatgggaagttactgttaaaaatcgcctaactggtgagaaattcaaacaagtaactgactacgtattcatcggtgctggcggtggagcaattccattattacaaaaaacaggtatccctgaaagtaaacatttgggtggattccctatcagtggtcaattcttagcttgtacaaacccacaagttattgaacaacacgatgccaaagtttatggtaaagagccacctggtacaccaccaatgactgtacctcatttagatacgcgttacattgatggtcaaagaacattattatttggaccatttgctaatgttggacctaaattcttgaaaaatggttctaacttagatttattcaagtctgttaaaacatacaacattacaactttattagcagcagcagttaaaaacttacctttaattaaatactcatttgaccaagtaattatgacaaaagaaggttgtatgaaccacttacgtactttctatccagaagcacgtaatgaagattggcaattatacactgctggtaaacgtgtacaagttatcaaagatacacctgaacacggtaaaggattcatccaattcggtacagaagtggttaactcacaagaccacactgtaattgcattattaggtgaatcaccaggggcttcaacttcagtttcagttgcgttagaagtattagaacgtaacttccctgaatacaaaactgaatgggcacctaaaattaagaaaatgattccatcatacggtgaatcattaattgaagacgaaaaattaatgagaaaaatccgtaaacaaacttcaaaagacttagaattaggttactacgaaaac

SEQ ID NO: 112 - protein, 501 aa, Staphylococcus aureus
MKPMAKSNSKDIVLIGAGVLSTTFGSMLKEIEPDWNIHVYERLDRPAIESSNERNNAGTGHAALCELNYTVLQPDGSIDIEKAKVINEEFEISKQFWGHLVKSGSIENPREFINPLPHISYVRGKNNVKFLKDRYEAMKAFPMFDNIEYTEDIEVMKKWIPLMMKGREDNPGIMAASKIDEGTDVNFGELTRKMAKSIEAHPNATVQFNHEVVDFEQLSNGQWEVTVKNRLTGEKFKQVTDYVFIGAGGGAIPLLQKTGIPESKHLGGFPISGQFLACTNPQVIEQHDAKVYGKEPPGTPPMTVPHLDTRYIDGQRTLLFGPFANVGPKFLKNGSNLDLFKSVKTYNITTLLAAAVKNLPLIKYSFDQVIMTKEGCMNHLRTFYPEARNEDWQLYTAGKRVQVIKDTPEHGKGFIQFGTEVVNSQDHTVIALLGESPGASTSVSVALEVLERNFPEYKTEWAPKIKKMIPSYGESLIEDEKLMRKIRKQTSKDLELGYYEN

SEQ ID NO: 113 - DNA, 741 bp, Staphylococcus aureus
atgctagaggcacaattttttactgatactggacaacatagagataagaatgaagatgcgggtggtattttttataatcaaactaatcaacaacttttagttctgtgtgatggtatgggtggccataaagcaggagaagttgcaagtaaatttgttacagatgagttgaaatcccgttttgaagcggaaaatcttatagaacaacatcaagctgaaaattggttgcgtaataatataaaagatataaattttcagttatatcactatgcacaagaaaatgcagaatataaaggtatgggtacaacatgtgtttgtgcacttgtttttgaaaaatcagttgtgatagcaaatgtcggtgattctagagcctatgttattaatagtcgacaaattgaacaaattactagtgatcactcatttgttaatcatcttgttttaacgggtcaaattacgccggaagaagcatttacacatccacaacgtaatattattacgaaggtgatgggcacagataaacgtgtgagtccagatttgtttattaagcgattaaatttttatgattatttattattaaattcagatggattaactgattatgttaaagacaatgaaattaagcgtttgttagtaaaagaaggtacaatagaagatcatggtgatcaattaatgcaattggcattagataaccattcgaaagataacgttactttcatactcgcggctattgaaggtgataaagta

SEQ ID NO: 114 - protein, 160 aa, Staphylococcus aureus
MATDTGHRDKNDAGGYNTNVCDGMGGHKAGVASKVTDKSRANHANWRNNKDNYHYANAYKGMGTTCVCAVKSVVANVGDSRAYVNSRTSDHSVNHVTGTATHRNTKVMGTDKRVSDKRNYDYNSDGTDYVKDNKRVKGTDHGDMADNHSKDNVTAAGDKV

SEQ ID NO: 115 - DNA, 1182 bp, Staphylococcus aureus
atggcaaaagaaaaattcgatcgttctaaagaacatgccaatatcggtactatcggtcacgttgaccatggtaaaacaacattaacagcagcaatcgctactgtattagcaaaaaatggtgactcagttgcacaatcatatgacatgattgacaacgctccagaagaaaaagaacgtggtatcacaatcaatacttctcacattgagtaccaaactgacaaacgtcactacgctcacgttgactgcccaggacacgctgactacgttaaaaacatgatcactggtgctgctcaaatggacggcggtatcttagtagtatctgctgctgacggtccaatgccacaaactcgtgaacacattcttttatcacgtaacgttggtgtaccagcattagtagtattcttaaacaaagttgacatggttgacgatgaagaattattagaattagtagaaatggaagttcgtgacttattaagcgaatatgacttcccaggtgacgatgtacctgtaatcgctggttcagcattaaaagctttagaaggcgatgctcaatacgaagaaaaaatcttagaattaatggaagctgtagatacttacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtttacatgacacatctaaaacaactgttacaggtgttgaaatgttccgtaaattattagactacgctgaagctggtgacaacattggtgcattattacgtggtgttgctcgtgaagacgtacaacgtggtcaagtattagctgctcctggttcaattacaccacatactgaattcaaagcagaagtatacgtattatcaaaagacgaaggtggacgtcacactccattcttctcaaactatcgtccacaattctatttccgtactactgacgtaactggtgttgttcacttaccagaaggtactgaaatggtaatgcctggtgataacgttgaaatgacagtagaattaatcgctccaatcgcgattgaagacggtactcgtttctcaatccgtgaaggtggacgtactgtaggatcaggcgttgttactgaaatcattaaa

SEQ ID NO: 116 - protein, 394 aa, Staphylococcus aureus
MAKEKFDRSKEHANIGTIGHVDHGKTTLTAAIATVLAKNGDSVAQSYDMIDNAPEEKERGITINTSHIEYQTDKRHYAHVDCPGHADYVKNMITGAAQMDGGILVVSAADGPMPQTREHILLSRNVGVPALVVFLNKVDMVDDEELLELVEMEVRDLLSEYDFPGDDVPVIAGSALKALEGDAQYEEKILELMEAVDTYIPTPERDSDKPFMMPVEDVFSITGRGTVATGRVERGQIKVGEEVEIIGLHDTSKTTVTGVEMFRKLLDYAEAGDNIGALLRGVAREEIQRGQVLAAPGSITPHTEFKAEVYVLSKDEGGRHTPFFSNYRPQFYFRTTDVTGVVHLPEGTEMVMPGDNVEMTVELIAPIAIDEGTRFSIREGGRTVGSGVVTEITE

SEQ ID NO: 117 - DNA, 929 bp, Staphylococcus aureus
atgactaagagtgctttagtaacaggtgcatcaagaggaattggacgtagtattgcgttacaattagcagaagaaggatataatgtagcagtaaactatgcaggcagcaaagagaaagctgaagcagtagtcgaagaaatcaaagctaaaggtgttgaaagttttgcgattcaagcaaatgttgccgatgcatgaaaatgactaagagtgctttagtaacaggtgcatcaagaggaattggacgtagtattgcgttacaattagcagaagaaggatataatgtagcagtaaactatgcaggcagcaaagagaaagctgaagcagtagtcgaagaaatcaaagctaaaggtgttgaaagttttgcgattcaagcaaatgttgccgatgctgatgaagttaaagcaatgattaaagaagtagttagccaatttggttctttagatgttttagtaaataatgcaggtattactcgcgataatttattaatgcgtatgaaagaacaagagtgggatgatgttattgacacaaacttaaaaggtgtatttaactgtatccaaaaagcaacaccacaaatgttaagacaacgtagtggtgctatcatcaatttatcaagtgttgttggagcagtaggtaatccgggacaagcaaactatgttgcaacaaaagcaggtgttattggtttaactaaatctgcggcgcgtgaattagcatctcgtggtatcactgtaaatgcagttgcacctggttttattgtttctgatatgacagatgctttaagtgatgagcttaaagaacaaatgttgactcaaattccgttagcacgttttggtcaagacacagatattgctaatacagtagcgttcttagcatcagacaaagcaaaatatattacaggtcaaacaatccatgtaaatggtggaatgtacatg

SEQ ID NO: 118 - protein, 244 aa, Staphylococcus aureus
MTKSALVTGASRGIGRSIALQLAEEGYNVAVNYAGSKEKAEAVVEEIKAKGVESFAIQANVADADEVKAMIKEVVSQFGSLDVLVNNAGITRDNLLMRMKEQEWDDVIDTNLKGVFNCIQKATPQMLRQRSGAIINLSSVVGAVGNPGQANYVATKAGVIGLTKSAARELASRGITVNAVAPGFIVSDMTDALSDELKEQMLTQIPLARFGQDTDIANTVAFLASDKAKYITGQTIHVNGGMYM

SEQ ID NO: 119 - DNA, 420 bp, Staphylococcus aureus
atgaaaatttctactaaagggagatatggacttacattgatgatttctcttgctaaaaaagaggggcaaggatgtatatcattaaagtcaattgctgaagaaaataatttgagtgatttatatttagaacagcttgtaggtcctttaagaaatgcggggttaattcgaagtgtacgcggtgctaaaggtggataccaattaagagtgccagcggaagaaatctcagcaggggatattataagactgttagaaggtccaattacatttgttgaaagtattgaatcagaaccacctgcgcaaaaacaactatggattcgcatgagagatgcagtgagagatgttttagataatacaacattgaaatatttagcggaatatgtagatacaagtgaagatttagacggatacatgttttatatt

SEQ ID NO: 120 - protein, 111 aa, Staphylococcus aureus
MLKISTKGRYGLTIMIELAKKHGEGPTSLKSIAQTNNLSEHYLEQLVSPLRNAGLVKSIRGAYGGYVLGSEPDAITAGDIIRVLEGPISLLKCWKMRSLPSVSSGFASGML

SEQ ID NO: 121 - DNA, 1290 bp, Staphylococcus aureus
gtggcatttgaatttagattacccgatatcggggaaggtatccacgaaggtgaaattgtaaaatggtttgttaaagctggagatactattgaagaagacgatgttttagctgaggtacaaaacgataaatcagtagtagaaatcccatcaccagtatctggtactgtagaagaagttatggtagaagaaggtacagtagctgtagttggtgacgttattgttaaaatcgatgcacctgatgcagaagatatgcaatttaaaggtcatgatgatgattcatcatctaaagaagaacctgcgaaagaggaagcgccagcagagcaagcacctgtagctactcaaactgaagaagtagatgaaaacagaactgttaaagcaatgccttcagtacgtaaatacgcacgtgaaaaaggtgttaacattaaagcagtttctggatctggtaaaaatggtcgtattacaaaagaagatgtagatgcatacttaaatggtggtgcaccaacagcttcaaatgaatcagctgcttcagctacaagtgaagaagttgctgaaactcctgcagcacctgcagcagtaacattagaaggcgacttcccagaaacaactgaaaaaatccctgctatgcgtagagcaattgcgaaagcaatggttaactctaagcatactgcacctcatgtaacattaatggatgaaattgatgttcaagcattatgggatcaccgtaagaaatttaaagaaatcgcagctgaacaaggtactaagttaacattcttaccttatgttgttaaagcacttgtttctgcattgaaaaaatacccagcacttaacacttcattcaatgaagaagctggtgaaatcgttcataaacattactggaatatcggtattgcagcagacactgatagaggattattagtacctgttgttaaacatgctgatcgtaagtctattttccaaatttcagatgaaattaatgaattagctgttaaagcacgtgatggtaaattaacagccgatgaaatgaaaggtgctacatgcacaatcagtaatatcggttcagctggtggacaatggttcactccagttatcaatcacccagaagtagcaatcttaggaattggccgtattgctcaaaaacctatcgttaaagatggagaaattgttgcagcaccagtattagcattatcattaagctttgaccacagacaaattgatggtgcaactggccaaaatgcaatgaatcacattaaacgtttattaaataatccagaattattattaatggagggg

SEQ ID NO: 122 - protein, 420 aa, Staphylococcus aureus
MAFEFRLPDIGEGIHEGEIVKWFVKAGDTIEEDDVLAEVQNDKSVVEIPSPVSGTVEEVMVEEGTVAVVGDVIVKIDAPDAEDMQFKGHDDDSSSKEEPAKEEAPAEQAPVATQTEEVDENRTVKAMPSVRKYAREKGVNIKAVSGSGKNGRITKEDVDAYLNGGAPTASNESAASATSEEVAETPAAPAAVTLEGDFPETTEKIPAMRRAIAKAMVNSKHTAPHVTLMDEIDVQALWDHRKKFKEIAAEQGTKLTFLPYVVKALVSALKKYPALNTSFNEEAGEIVHKHYWNIGIAADTDRGLLVPVVKHADRKSIFQISDEINELAVKARDGKLTADEMKGATCTISNIGSAGGQWFTPVINHPEVAILGIGRIAQKPIVKDGEIVAAPVLALSLSFDHRQIDGATGQNAMNHIKRLL

SEQ ID NO: 123 - DNA, 4143 bp, Staphylococcus aureus
atgctaaacagagaaaataaaacggcaataacaaggaaaggcatggtatccaatcgattaaataaattttcgattagaaagtacacagtgggaacagcatcaattttagtaggtacaacattaatttttggtctggggaaccaagaagcaaaggctgcagaaagtactaataaagaattgaacgaagcgacaacttcagcaagtgataatcaatcgagtgataaagttgatatgcagcaactaaatcaagaagacaatactaaaaatgataatcaaaaagaaatggtatcatctcaaggtaatgaaacgacttcaaatgggaataaattaatagaaaaagaaagtgtacaatctaccactggaaataaagttgaagtttcaactgccaaatcagatgagcaagcttcaccaaaatctacgaatgaagatttaaacactaaacaaactataagtaatcaagaagcgttacaacctgatttgcaagagaataaatcagtggtaaatgttcaaccaactaatgaggaaaacaaaaaggtagatgccaaaactgaatcaactacattaaatgttaaaagtgatgctatcaagagtaatgatgaaactcttgttgataacaatagtaattcaaataatgaaaataatgcagatatcattttgccaaaaagtacagcacctaaacgtttgaatacaagaatgcgtatagcagcagtacagccatcatcaacagaggctaaaaatgttaatgatttaatcacatcaaatacaacattaactgtcgttgatgcagataaaaacaataaaatcgtaccagcccaagattatttatcattaaaatcacaaattacagttgatgacaaagttaaatcaggtgattatttcacaattaaatactcagatacagtacaagtatatggattgaatccggaagatattaaaaatattggtgatattaaagatccaaataatggtgaaacaattgcgactgcaaaacatgatactgcaaataatttaattacatatacatttacagattatgttgatcgatttaattctgtacaaatgggaattaattattcaatttatatggatgctgatacaattcctgttagtaaaaacgatgttgagtttaatgttacgataggtaatactacaacaaaaacaactgctaacattcaatatccagattatgttgtaaatgagaaaaattcaattggatcagcgttcactgaaacagtttcacatgttggaaataaagaaaatccagggtactataaacaaacgatttatgtaaatccatcggaaaattctttaacaaatgccaaactaaaagttcaagcttaccactcaagttatcctaataatatcgggcaaataaataaagatgtaacagatataaaaatatatcaagttcctaaaggttatacattaaataaaggatacgatgtgaatactaaagagcttacagatgtaacaaatcaatacttgcagaaaattacatatggcgacaacaatagcgctgttattgattttggaaatgcagattctgcttatgttgtaatggttaatacaaaattccaatatacaaatagcgaaagcccaacacttgttcaaatggctactttatcttcaacaggtaataaatccgtttctactggcaatgctttaggatttactaataaccaaagtggcggagctggtcaagaagtatataaaattggtaactacgtatgggaagatactaataaaaacggtgttcaagaattaggagaaaaaggcgttggcaatgtaactgtaactgtatttgataataatacaaatacaaaagtaggagaagcagttactaaagaagatgggtcatacttgattccaaacttacctaatggagattaccgtgtagaattttcaaacttaccaaaaggttatgaagtaaccccttcaaaacaaggtaataacgaagaattagattcaaacggcttatcttcagttattacagttaatggcaaagataacttatctgcagacttaggtatttacaaacctaaatacaacttaggtgactatgtctgggaagatacaaataaaaatggtatccaagaccaagatgaaaaaggtatatctggcgtaacggtaacattaaaagatgaaaacggtaacgtgttaaaaacagttacaacagacgctgatggcaaatataaatttactgatttagataatggtaattataaagttgaatttactacaccagaaggctatacaccgactacagtaacatctggtagcgacattgaaaaagactctaatggtttaacaacaacaggtgttattaatggtgctgataacatgacattagatagtggattctacaaaacaccaaaatataatttaggtaattatgtatgggaagatacaaataaagatggtaagcaggattcaactgaaaaaggtatttcaggcgtaacagttacattgaaaaatgaaaacggtgaagttttacaaacaactaaaacagataaagatggtaaatatcaatttactggattagaaaatggaacttataaagttgaattcgaaacaccatcaggttacacaccaacacaagtaggttcaggaactgatgaaggtatagattcaaatggtacatcaacaacaggtgtcattaaagataaagataacgatactattgactctggtttctacaaaccgacttacaacttaggtgactatgtatgggaagatacaaataaaaacggtgttcaagataaagatgaaaagggcatttcaggtgtaacagttacgttaaaagatgaaaacgacaaagttttaaaaacagttacaacagatgaaaatggtaaatatcaattcactgatttaaacaatggaacttataaagttgaattcgagacaccatcaggttatacaccaacttcagtaacttctggaaatgatactgaaaaagattctaatggtttaacaacaacaggtgtcattaaagatgcagataacatgacattagacagtggtttctataaaacaccaaaatatagtttaggtgattatgtttggtacgacagtaataaagacggcaaacaagattcaactgaaaaaggtatcaaagatgttaaagttactttattaaatgaaaaaggcgaagtaattggaacaactaaaacagatgaaaatggtaaatactgctttgataatttagatagcggtaaatacaaagttatttttgaaaagcctgctggcttaacacaaacaggtacaaatacaactgaagatgataaagatgcagatggtggcgaagttgacgtaacaattacggatcatgatgatttcacacttgataatggctactacgaagaagaaacatcagatagcgactcagattcggacagcgactcagattcagacagagactcagactcagatagtgattcagactcggatagcgattcagattcagacagcgattcagattcagatagcgattcagattcagacagagactcagatagtgattcagactcagatagcgactcagattcagacagcgactcagattcagacagcgactcagactcagatagtgattcagactcagatagcgactcagattcagacagcgactcagactcagacagcgactcagactcagatagtgactcagattcagatagcgactcagattcggacagcgattcagactcagatagcgactcagattcagatagcgattcggactcagatagcgactcagattcagatagtgattcagactcagatagcgactcagattcagacagcgactcagattcggatagcgactcagattcagacagcgactcagactcggatagtgattcagactcagatagcgactcagactcagatagcgattcagattcagatagcgactcagactcagacagcgattcagactcagacagcgactcagactcagatgcaggtaagcacacacctgttaaaccaatgagtactactaaagaccatcacaataaagcaaaagcattaccagaaacaggtaatgaaaatagcggctcaaataacgcaacgttatttggcggattattcgcagcattaggatcattattgttattcggtcgtcgtaaaaaacaaaataaa

SEQ ID NO: 124 - protein, 1315 aa, Staphylococcus aureus
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 125 - DNA, 3549 bp, Staphylococcus aureus
ttggcaggtcaagttgtccaatatggaagacatcgtaaacgtagaaactacgcgagaatttcagaagtattagaattaccaaacttaatagaaattcaaactaaatcttacgagtggttcctaagagaaggtttaatcgaaatgtttagagacatttctccaattgaagattttactggtaatttgtcattagagtttgtggattaccgtttaggagaaccaaaatatgatttagaagaatctaaaaaccgtgacgctacttatgctgcacctcttcgtgtaaaagtgcgtctaatcattaaagaaacaggagaagttaaagaacaagaagtctttatgggtgatttcccattaatgactgatacaggtacgttcgttatcaatggtgcagaacgtgtaatcgtatctcaattagttcgttcaccatccgtttatttcaatgaaaaaatcgacaaaaatggtcgtgaaaactatgatgcaacaattattccaaaccgtggtgcatggttagaatatgaaacagatgctaaagatgttgtatacgtacgtattgatagaacacgtaaactaccattaacagtattgttacgtgcattaggtttctcaagcgaccaagaaattgttgaccttttaggtgacaatgaatatttacgtaatactttagagaaagacggcactgaaaacactgaacaagcgttattagaaatctatgaacgtttacgtccaggtgaaccaccaactgttgaaaatgctaaaagtctattgtattcacgtttctttgatccaaaacgctatgacttagcaagcgtgggtcgttataaaacaaacaaaaaattacatttaaaacatcgtttatttaatcaaaaattagctgagccaattgtaaatactgaaactggtgaaattgtagttgaagaaggtacagtgcttgatcgtcgtaaaatcgacgaaatcatggatgtacttgaatcaaatgcaaacagcgaagtgtttgaattgcatggtagcgttatagacgagccagtagaaattcaatcaattaaagtatatgttcctaacgatgatgaaggtcgtacgacaactgtaattggtaatgctttccctgactcagaagttaaatgcattacaccagcagatatcattgcttcaatgagttacttctttaacttattaagcggtattggatatacagatgatattgaccatttaggtaaccgtcgtttacgttctgtaggtgaattactacaaaaccaattccgtatcggtttatcaagaatggaaagagttgtacgtgaaagaatgtcaattcaagatactgagtctatcacacctcaacaattaattaatattcgacctgttattgcatctattaaagaattctttggtagctctcaattatcacaattcatggaccaagcaaacccattagctgagttaacgcataaacgtcgtctatcagcattaggacctggtggtttaacacgtgaacgtgctcaaatggaagtacgtgacgttcactactctcactatggccgtatgtgtccaattgaaacacctgagggaccaaacattggattgattaactcattatcaagttatgcacgtgtaaatgaattcggctttattgaaacaccatatcgtaaagttgatttagatacacatgctatcactgatcaaattgactatttaacagctgacgaagaagatagctatgttgtagcacaagcaaactctaaattagatgaaaatggtcgtttcatggatgatgaagttgtatgtcgtttccgtggtaacaatacagttatggctaaagaaaaaatggattatatggatgtatcgccgaagcaagttgtttcagcagcgacagcatgtattccattcttagaaaatgatgactcaaaccgtgcattgatgggtgcgaacatgcaacgtcaagcagtgcctttgatgaatccagaagcaccatttgttggtacaggtatggaacacgttgcagcacgtgattctggtgcggctattacagctaagcacagaggtcgtgttgaacatgttgaatctaatgaaattcttgttcgtcgtctagttgaagagaacggcgttgagcatgaaggtgaattagatcgctatccattagctaaatttaaacgttcaaactcaggtacatgttacaaccaacgtccaatcgttgcagttggagatgttgttgagtataacgagattttagcagatggaccatctatggaattaggagaaatggcattaggtagaaacgtagtagttggtttcatgacttgggacggttacaactatgaggatgccgttatcatgagtgaaagacttgtgaaagatgacgtgtatacttctattcatattgaagagtatgaatcagaagtacgtgatactaagttaggacctgaagaaatcacaagagatattcctaatgtttctgaaagtgcacttaagaacttagacgatcgtggtatcgtttatattggtgcagaagtaaaagatggagatattttagttggtaaagtaacgcctaaaggtgtaactgagttaactgccgaagaaagattgttacatgcaatctttggtgaaaaagcacgtgaagttagagatactttattacgtgtacctcacggcgctggcggtatcgttcttgatgtaaaagtattcaatcgtgaagaaggcgacgatacattatcacctggtgtaaaccaattagtacgtgtatatatcgttcaaaaacgtaaaattcatgttggtgataagatgtgtggtcgacatggtaacaaaggtgtcatttctaagattgttcctgaagaagatatgccttacttaccagatggacgtccgatcgatatcatgttaaatcctcttggtgtaccatctcgtatgaacatcggacaagtattagagctacacttaggtatggctgctaaaaatcttggtattcacgttgcatcaccagtatttgacggtgcaaacgatgacgatgtatggtcaacaattgaagaagctggtatggctcgtgatggtaaaactgtactttatgatggacgtacaggtgaaccattcgataaccgtatttcagtaggtgtaatgtacatgttgaaacttgcgcacatggttgatgataaattacatgcgcgttcaacaggaccatattcacttgttacacaacaaccacttggcggtaaagcgcaattcggtggacaacgttttggtgagatggaggtatgggcacttgaagcatatggtgctgcatacacattacaagaaatcttaacttacaaatccgatgatacagtaggacgtgtgaaaacatacgaggctattgttaaaggtgaaaacatctctagaccaagtgttccagaatcattccgagtattgatgaaagaattacaaagtttaggtttagatgtaaaagttatggatgagcaagataatgaaatcgaaatgacagacgttgatgacgatgatgttgtagaacgcaaagtagatttacaacaaaatgatgctcctgaaacacaaaaagaagttactgat

SEQ ID NO: 126 - protein, 1182 aa, Staphylococcus aureus
MAGQVVQYGRHRKRRNYARISEVLELPNLIEIQTKSYEWFLREGLIEMFRDISPIEDFTGNLSLEFVDYRLGEPKYDLEESKNRDATYAAPLRVKVRLIIKETGEVKEQEVFMGDFPLMTDTGTFVINGAERVIVSQLVRSPSVYFNEKIDKNGRENYDATIIPNRGAWLEYETDAKDVVYVRIDRTRKLPLTVLLRALGFSSDQEIVDLLGDNEYLRNTLEKDGTENTEQALLEIYERLRPGEPPTVENAKSLLYSRFFDPKRYDLASVGRYKTNKKLHLKHRLFNQKLAEPIVNTETGEIVVEEGTVLDRRKIDEIMDVLESNANSEVFELHGSVIDEPVEIQSIKVYVPNDDEGRTTTVIGNAFPDSEVKCITPADIIASMSYFFNLLSGIGYTDDIDHLGNRRLRSVGELLQNQFRIGLSRMERVVRERMSIQDTESITPQQLINIRPVIASIKEFFGSSQLSQFMDQANPLAELTHKRRLSALGPGGLTRERAQMEVRDVHYSHYGRMCPIETPEGPNIGLINSLSSYARVNEFGFIETPYRKVDLDTHAITDQIDYLTADEEDSYVVAQANSKLDENGRFMDDEVVCRFRGNNTVMAKEKMDYMDVSPKQVVSAATACIPFLENDDSNRALMGANMQRQAVPLMNPEAPFVGTGMEHVAARDSGAAITAKHRGRVEHVESNEILVRRLVEENGVEHEGELDRYPLAKFKRSNSGTCYNQRPIVAVGDVVEYNEILADGPSMELGEMALGRNVVVGFMTWDGYNYEDAVIMSERLVKDDVYTSIHIEEYESRRQRDTKLGPEEITRDIPNVSESALKNLDDRGIVYIGAEVKDGDILVGKVTPKGVTELTAEERLLHAIFGEKAREVRDTSLRVPHGAGGIVLDVKVFNREEGDDTLSPGVNQLVRVYIVQKRKIHVGDKMCGRHGNKGVISKIVPEEDMPYLPDGRPIDIMLNPLGVPSRMNIGQVLELHLGMAAKNLGIHVASPVFDGANDDDVWSTIEEAGMARDGKTVLYDGRTGEPFDNRISVGVMYMLKLAHMVDDKLHARSTGPYSLVTQQPLGGKAQFGGQRFGEMEVWALEAYGAAYTLQEILTYKSDDTVGRVKTYEAIVKGENISRPSVPESFRVLMKELQSLGLDVKVMDEQDNEIEMTDVDDDDVVERKVDLQQNDAPETQKSY

SEQ ID NO: 127 - DNA, 2145 bp, Staphylococcus aureus
atgcttagggcatcgccatatctatcgtatttattcagtaatataaactggaaggagaaaaaatacatggctagagaattttcattagaaaaaactcgtaatatcggtatcatggctcacattgatgctggtaaaacgactacgactgaacgtattctttattacactggccgtatccacaaaattggtgaaacacacgaaggtgcttcacaaatggactggatggagcaagaacaagaccgtggtattactatcacatctgctgcaacaacagcagcttgggaaggtcaccgtgtaaacattatcgatacacctggacacgtagacttcactgtagaagttgaacgttcattacgtgtacttgacggagcagttacagtacttgatgcacaatcaggtgttgaacctcaaactgaaacagtttggcgtcaggctacaacttatggtgttccacgtatcgtatttgtaaacaaaatggacaaattaggtgctaacttcgaatactctgtaagtacattacatgatcgtttacaagctaacgctgctccaatccaattaccaattggtgcggaagacgaattcgaagcaatcattgacttagttgaaatgaaatgtttcaaatatacaaatgatttaggtactgaaattgaagaaattgaaattcctgaagaccacttagatagagctgaagaagctcgtgctagcttaatcgaagcagttgcagaaactagcgacgaattaatggaaaaatatcttggtgacgaagaaatttcagtttctgaattaaaagaagctatccgccaagctactactaacgtagaattctacccagtactttgtggtacagctttcaaaaacaaaggtgttcaattaatgcttgacgctgtaattgattacttaccttcaccactagacgttaaaccaattattggtcaccgtgctagcaaccctgaagaagaagtaatcgcgaaagcagacgattcagctgaattcgctgcattagcgttcaaagttatgactgacccttatgttggtaaattaacattcttccgtgtgtattcaggtacaatgacatctggttcatacgttaagaactctactaaaggtaaacgtgaacgtgtaggtcgtttattacaaatgcacgctaactcacgtcaagaaatcgatactgtatactctggagatatcgctgctgcggtaggtcttaaagatacaggtactggtgatactttatgtggtgagaaaaatgacattatcttggaatcaatggaattcccagagccagttattcacttatcagtagagccaaaatctaaagctgaccaagataaaatgactcaagctttagttaaattacaagaagaagacccaacattccatgcacacactgacgaagaaactggacaagttatcatcggtggtatgggtgagcttcacttagacatcttagtagaccgtatgaagaaagaattcaacgttgaatgtaacgtaggtgctccaatggtttcatatcgtgaaacattcaaatcatctgcacaagttcaaggtaaattctctcgtcaatctggtggtcgtggtcaatacggtgatgttcacattgaattcacaccaaacgaaacaggcgcaggtttcgaattcgaaaacgctatcgttggtggtgtagttcctcgtgaatacattccatcagtagaagctggtcttaaagatgctatggaaaatggtgttttagcaggttatcctttaattgatgttaaagctaaattatatgatggttcataccatgatgtcgattcatctgaaatggccttcaaaattgctgcatcattagcacttaaagaagctgctaaaaaatgtgatcctgtaatcttagaaccaatgatgaaagtaactattgaaatgcctgaagagtacatgggtgatatcatgggtgacgtaacatctcgtcgtggacgtgttgatggtatggaacctcgtggtaatgcacaagttgttaatgcttatgtaccactttcagaaatgttcggttatgcaacatcattacgttcaaacactcaaggtcgcggtacttacactatgtacttcgatcactatgctgaagttccaaaatcaatcgctgaagatattatcaagaaaaataaaggtgaa

SEQ ID NO: 128 - protein, 693 aa, Staphylococcus aureus
MAREFSLEKTRNIGIMAHIDAGKTTTTERILYYTGRIHKIGETHEGASQMDWMEQEQDRGITITSAATTAAWEGHRVNIIDTPGHVDFTVEVERSLRVLDGAVTVLDAQSGVEPQTETVWRQATTYGVPRIVFVNKMDKLGANFEYSVSTLHDRLQANAAPIQLPIGAEDEFEAIIDLVEMKCFKYTNDLGTEIEEIEIPEDHLDRAEEARASLIEAVAETSDELMEKYLGDEEISVSELKEAIRQATTNVEFYPVLCGTAFKNKGVQLMLDAVIDYLPSPLDVKPIIGHRASNPEEEVIAKADDSAEFAALAFKVMTDPYVGKLTFFRVYSGTMTSGSYVKNSTKGKRERVGRLLQMHANSRQEIDTVYSGDIAAAVGLKDTGTGDTLCGEKNDIILESMEFPEPVIHLSVEPKSKADQDKMTQALVKLQEEDPTFHAHTDEETGQVIIGGMGELHLDILVDRMKKEFNVECNVGAPMVSYRETFKSSAQVQGKFSRQSGGRGQYGDVHIEFTPNETGAGFEFENAIVGGVVPREYIPSVEAGLKDAMENGVLAGYPLIDVKAKLYDGSYHDVDSSEMAFKIAASLALKEAAKKCDPVILEPMMKVTIEMPEEYMGDIMGDVTSRRGRVDGMEPRGNAQVVNAYVPLSEMFGYATSLRSNTQGRGTYTMYFDHYAEVPKSIAEDIIKKNKGE

SEQ ID NO: 129 - DNA, 513 bp, Staphylococcus aureus
atgactaaaaaagtagcaattattctagcaaacgaatttgaagatatagaatattcaagccctaaagaggcattagagaatgcaggctttaatactgtagtgattggagatactgcaaatagtgaagttgttggtaaacacggtgaaaaagttactgtcgatgtaggcattgcagaagctaaaccagaagattatgatgcattattaattcctggaggattttcaccagatcatttacgtggagatacagaaggtcgatatggcacatttgctaaatactttactaaaaatgatgtaccaacatttgccatttgtcatgggccacaaatactaatagatacagacgatttaaaaggtcgtacgttaacagcagtattaaatgtacgcaaagatttatcaaatgcaggcgcacatgtagttgatgagtcagtagttgtagacaacaatattgtaacaagtcgagtaccagacgatttagatgattttaatcgagaaatcgttaaacaattacaa

SEQ ID NO: 130 - protein, 171 aa, Staphylococcus aureus
MTKKVAIILANEFEDIEYSSPKEALENAGFNTVVIGDTANSEVVGKHGEKVTVDVGIAEAKPEDYDALLIPGGFSPDHLRGDTEGRYGTFAKYFTKNDVPTFAICHGPQILIDTDDLKGRTLTAVLNVRKDLSNAGAHVVDESVVVDNNIVTSRVPDDLDDFNREIVKQLQ

SEQ ID NO: 131 - DNA, 366 bp, Staphylococcus aureus
atggctaatcatgaacaaatcattgaagcgattaaagaaatgtcagtattagaattaaacgacttagtaaaagcaattgaagaagaatttggtgtaactgcagctgctccagtagcagtagcaggtgcagctggtggcgctgacgctgcagcagaaaaaactgaatttgacgttgagttaacttcagctggttcatctaaaatcaaagttgttaaagctgttaaagaagcaactggtttaggattaaaagatgctaaagaattagtagacggagctcctaaagtaatcaaagaagctttacctaaagaagaagctgaaaaacttaaagaacaattagaagaagttggagctactgtagaattaaaa

SEQ ID NO: 132 - protein, 122 aa, Staphylococcus aureus
MANHEQIIEAIKEMSVLELNDLVKAIEEEFGVTAAAPVAVAGAAGGADAAAEKTEFDVELTSAGSSKIKVVKAVKEATGLGLKDAKELVDGAPKVIKEALPKEEAEKLKEQLEEVGATVELK

SEQ ID NO: 133 - DNA, 630 bp, Staphylococcus aureus
gtggaattacaattagcaattgatttattaaacaaagaagacgcggctgagttagcaaataaagtaaaagattatgtagatatcgtagaaatcggtacgccaatcatttacaacgaaggtttaccagcagttaaacatatggcagacaacattagtaatgtaaaagtattagcagacatgaaaattatggatgcagctgattatgaagttagccaagcaattaaatttggcgcggatgtaattacaatactaggtgttgcagaagatgcatcaattaaagcagctattgaagaagctcataaaaataataaacaattactagttgatatgattgctgttcaagatttagaaaaacgtgcaaaagaactagatgaaatgggtgctgattatattgcagtacacactggttatgatttacaagcagaagggcaatcaccattagaaagtttaagaaccgttaaatctgttattaaaaattctaaagttgcagtagcaggtggaattaaaccagatacaattaaagatattgtcgctgaaagtcctgatcttgttattgttggtggcggaatcgcaaatgcagatgatccagtagaagctgcaaaacaatgtcgcgctgcaatcgaaggtaag

SEQ ID NO: 134 - protein, 210 aa, Staphylococcus aureus
MELQLAIDLLNKEDAAELANKVKDYVDIVEIGTPIIYNEGLPAVKHMADNISNVKVLADMKIMDAADYEVSQAIKFGADVITILGVAEDASIKAAIEEAHKNNKQLLVDMIAVQDLEKRAKELDEMGADYIAVHTGYDLQAEGQSPLESLRTVKSVIKNSKVAVAGGIKPDTIKDIVAESPDLVIVGGGIANADDPVEAAKQCRAAIEGK

SEQ ID NO: 135 - DNA, 927 bp, Staphylococcus aureus
atgaaaaaattagtacctttattattagccttattacttctagttgctgcatgtggtactggtggtaaacaaagcagtgataagtcaaatggcaaattaaaagtagtaacgacgaattcaattttatatgatatggctaaaaatgttggtggagacaacgtcgatattcatagtattgtacctgttggtcaagatcctcatgaatatgaagttaaacctaaagatattaaaaagttaactgacgctgacgttattttatacaacggattaaatttagagactggtaacggttggtttgaaaaagccttagaacaggctggtaaatcattaaaagataaaaaagttatcgcagtatcaaaagatgttaaacctatctatttaaacggtgaagaaggcaacaaagataaacaagatccacacgcatggttaagtttagataacggtattaaatacgtaaaaacaattcaacaaacatttatcgataacgacaaaaaacataaagcagattatgaaaagcaaggtaacaaatacattgctcaattggaaaaattaaataatgacagtaaagacaaatttaatgacattccaaaagaacaacgtgccatgattacaagtgaaggtgccttcaagtacttctcaaaacaatacggtattacaccaggttatatttgggaaattaacactgaaaaacaaggtacacctgaacaaatgagacaagctattgagtttgttaaaaagcacaaattaaaacacttattagtagaaacaagtgttgataagaaagcaatggaaagtttatctgaagaaacgaagaaagatatctttggtgaagtgtacacagattcaatcggtaaagaaggcactaaaggtgactcttactacaaaatgatgaaatcaaatattgaaactgtacacggaagcatgaaa

SEQ ID NO: 136 - protein, 309 aa, Staphylococcus aureus
MKKLVPLLLALLLLVAACGTGGKQSSDKSNGKLKVVTTNSILYDMAKNVGGDNVDIHSIVPVGQDPHEYEVKPKDIKKLTDADVILYNGLNLETGNGWFEKALEQAGKSLKDKKVIAVSKDVKPIYLNGEEGNKDKQDPHAWLSLDNGIKYVKTIQQTFIDNDKKHKADYEKQGNKYIAQLEKLNNDSKDKFNDIPKEQRAMITSEGAFKYFSKQYGITPGYIWEINTEKQGTPEQMRQAIEFVKKHKLKHLLVETSVDKKAMESLSEETKKDIFGEVYTDSIGKEGTKGDSYYKMMKSNIETVHGSMK

SEQ ID NO: 137 - DNA, 1305 bp, Staphylococcus aureus
atgacaactgatattttgaacatttctgaagaacaacttgttgattattctaaagcccacaatgaaccttcttggatgacagaattacgtaaaaaagctttgaaattaacagaaactttagaaatgccaaaacctgataaaacaaaattaagaaaatgggattttgattcttttaaacaacacgatgtaaaaggtgatgtttatcaatctttatcacaattacctgagtcagtaagagaaattattgacgtagatcattctaaaaacttagtaattcaacataataatacgattgcgtacacacaagttgatgataatgcatcgaaagatggcgttatcgttgaaggtttagcagacgctcttatgaaccatagtgatttagtacaaaagtactttatgaaagatgcagtaacagtagatgaacatcgtatcacagcgctacacacggcattagttaatggtggcgtatttgtttatgttcctaaaaatgtagttgtagaacatccagtacaatacgttgtgttgcacgacgacgaaaatgcaagcttttataaccatgttatcatcgttactgaagaaagcgccgaagtcacatatgttgaaaattacttatcaaatgcatctggtgaaggaaatcaattaaatattatttctgaagtgattgctggtgcaaattcaaatatcacatatggctcagtggactatatggataaaggctttacaggtcatatcattcgacgtggtattactgaagcggatgcctcaattaattgggcactaggtttaatgaatgagggtagccaaattattgataatacaacaaatttatttggtgatcgttcaacaagttcacttaaatcagtagttgtaggtacaggcgaacaaaaaattaatctaacatctaaaatcgtacaatatggtaaagaaacagatggttatatccttaaacatggtgttatgaaagaacatgcatcgtctgtatttaatggtatcggctacattaagcatggtggaactaaatcaattgctaatcaggaatcacgtgtattaatgttatctgaacatgctcgtggtgacgcgaatcctattttattaattgatgaagatgatgtacaagctggtcatgctgcatcagtaggtcgtgttgatccagatcaactttactatttaatgagtcgtggtatttctcaaagagaagcggaacgtcttgttatacatggtttcttagatccagtagtacgtgaattacctatcgaagacgttaaacgtcaattgagagaagtaattgaacgcaaagtttctaaa

SEQ ID NO: 138 - protein, 435 aa, Staphylococcus aureus
MTTDILNISEEQLVDYSKAHNEPSWMTELRKKALKLTETLEMPKPDKTKLRKWDFDSFKQHDVKGDVYQSLSQLPESVREIIDVDHSKNLVIQHNNTIAYTQVDDNASKDGVIVEGLADALMNHSDLVQKYFMKDAVTVDEHRITALHTALVNGGVFVYVPKNVVVEHPVQYVVLHDDENASFYNHVIIVTEESAEVTYVENYLSNASGEGNQLNIISEVIAGANSNITYGSVDYMDKGFTGHIIRRGITEADASINWALGLMNEGSQIIDNTTNLFGDRSTSSLKSVVVGTGEQKINLTSKIVQYGKETDGYILKHGVMKEHASSVFNGIGYIKHGGTKSIANQESRVLMLSEHARGDANPILLIDEDDVQAGHAASVGRVDPDQLYYLMSRGISQREAERLVIHGFLDPVVRELPIEDVKRQLREVIERKVSK

SEQ ID NO: 139 - DNA, 1875 bp, Staphylococcus aureus
gtggttcaagaatatgatgtaatcgttataggtgcgggacatgcaggtgtagaagcaggtttagcatctgcaagacgtggtgctaaaacattaatgctaacaataaatttagataatattgcatttatgccatgtaacccatctgtaggtggaccagctaaaggtatcgttgttcgtgaaattgatgctttaggtggacaaatggcaaaaacaatcgataaaacacacattcaaatgagaatgttaaatacaggtaaaggacctgctgtaagagcactaagagcgcaagcagataaagtactttatcaacaagaaatgaaacgcgtgattgaagatgaagaaaatttgcatataatgcaaggtatggtagacgaacttattatagaagataatgaagttaaaggtgtacgtacaaatattggtacagagtatttatctaaagcagtaattattacaacgggaacatttttacgtggtgaaatcattttaggtaatatgaagtattcaagtggaccaaatcaccaattaccatcaatcacattatcagacaatttaagagaacttggttttgatattgttcgttttaaaacaggtacaccaccgcgtgtaaattcaaaaacaattgactattcgaagactgaaatacaaccaggtgacgatgtaggtcgtgcattcagctttgaaacaacagaatatatattagatcaattgccatgttggctaacgtatactaatgctgaaacacacaaagttatcgatgataatttacatctatctgcaatgtattcagggatgattaaaggaaccgggccacgttattgcccttcaattgaagataaatttgttcgatttaatgataagccgcgacatcaacttttcttagagcctgaaggtcgtaatacaaatgaagtatatgtgcaaggattgtctacaagtcttcctgaacatgtgcaacgtcaaatgttagagacgataccaggtcttgaaaaagcagatatgatgcgtgccggctacgcaattgaatatgatgcgattgtgccaacgcagttatggcctacacttgaaacgaaaatgattaaaaacttatatactgcaggtcaaattaatggtacatctggttatgaagaagcagcaggacaaggattgatggcaggtattaacgctgcaggtaaagtgttaaacacaggcgaaaagatattaagtcgttcagatgcatatattggtgtcttaatcgatgatcttgtaactaaaggtactaatgaaccttatcgtttactaacatcacgtgcagaatatcgtttgttactacgtcatgataatgctgatttgagattgacggatatgggatatgaacttggtatgatttctgaagaaagatatgcacgttttaatgaaaaacgtcagcaaattgatgcggaaattaagcgtttatcagatattcgtattaaaccaaacgaacatacgcaagcgattattgaacaacatggtggttctcgcttaaaagatggtattttagctatcgatttattacgcagacctgaaatgacttacgatataattttagaacttttagaagaagaacatcaattgaatgcagatgttgaagaacaagtagaaatacaaacaaaatatgaaggttatatcaataaatcactacaacaagttgagaaagttaagcgtatggaagagaagaaaattccagaagacttagattatagtaagattgatagtttggcgactgaagcgcgagaaaaattatcagaagtaaaacctttaaatattgcacaagcttctagaatatcaggggtaaatccagcagacatatctatattattgatttacttagaacaaggtaaactccaaagggtgagtgac

SEQ ID NO: 140 - protein, 625 aa, Staphylococcus aureus
MVQEYDVIVIGAGHAGVEAGLASARRGAKTLMLTINLDNIAFMPCNPSVGGPAKGIVVREIDALGGQMAKTIDKTHIQMRMLNTGKGPAVRALRAQADKVLYQQEMKRVIEDEENLHIMQGMVDELIIEDNEVKGVRTNIGTEYLSKAVIITTGTFLRGEIILGNMKYSSGPNHQLPSITLSDNLRELGFDIVRFKTGTPPRVNSKTIDYSKTEIQPGDDVGRAFSFETTEYILDQLPCWLTYTNAETHKVIDDNLHLSAMYSGMIKGTGPRYCPSIEDKFVRFNDKPRHQLFLEPEGRNTNEVYVQGLSTSLPEHVQRQMLETIPGLEKADMMRAGYAIEYDAIVPTQLWPTLETKMIKNLYTAGQINGTSGYEEAAGQGLMAGINAAGKVLNTGEKILSRSDAYIGVLIDDLVTKGTNEPYRLLTSRAEYRLLLRHDNADLRLTDMGYELGMISEERYARFNEKRQQIDAEIKRLSDIRIKPNEHTQAIIEQHGGSRLKDGILAIDLLRRPEMTYDIILELLEEEHQLNADVEEQVEIQTKYEGYINKSLQQVEKVKRMEEKKIPEDLDYSKIDSLATEAREKLSEVKPLNIAQASRISGVNPADISILLIYLEQGKLQRVSD

SEQ ID NO: 141 - protein, 389 aa, Staphylococcus aureus
  MOD_RES (19): X = anything
LMINEREVFILIYLDNAAXTKAFEEVLDTYLKVNQSMYYNPNSPHKAGLQANQLLQQAKTQINAMINSKTNYDVVFTSGATESNNLALKGIAYRKFDTAKEIITSVLEHPSVLEVVRYLEAHEGFKVKYVDVKKDGSINLEHFKELMSDKVGLVTCMYVNNVTGQIQPIPQMAKVIKNYPKAHFHVDAVQAFGKISMDLNNIDSISLSGHKFNGLKGQGVLLVNHIQNVEPTVHGGGQEYGVRSGTVNLPNDIAMVKAMKIANENFEALNAFVTELNNDVRQFLNKYHGVYINSSTSGSPFVLNISFPGVKGEVLVNAFSKYDIMISTTSACSSKRNKLNEVLAAMGLSDKSIEGSIRLSFGATTTKEDIARFKEIFIIIYEEIKELLK

SEQ ID NO: 142 - protein, 645 aa, Staphylococcus aureus
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKEVKAPKETKEVKPAAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKGVTLATKPTKGEVESSSTTPTKVVSTTQNVAKPTTGSSKTTKDVVQTSAGSSEAKDSAPLQKANIKHTNDGHTQSQNNKNTQENKAKSLPQTGEESNKDMTLPLMALLALSSIVAFVLPRKRKN

SEQ ID NO: 143 - DNA, 3822 bp, Staphylococcus aureus
atgagctggtttgataaattattcggcgaagataatgattcaaatgatgacttgattcatagaaagaaaaaaagacgtcaagaatcacaaaatatagataacgatcatgactcattactgcctcaaaataatgatatttatagtcgtccgaggggaaaattccgttttcctatgagcgtagcttatgaaaatgaaaatgttgaacaatctgcagatactatttcagatgaaaaagaacaataccatcgagactatcgcaaacaaagccacgattctcgttcacaaaaacgacatcgccgtagaagaaatcaaacaactgaagaacaaaattatagtgaacaacgtgggaattctaaaatatcacagcaaagtataaaatataaagatcattcacattaccatacgaataagccaggtacatatgtttctgcaattaatggtattgagaaggaaacgcacaagccaaaaacacataatatgtattctaataatacaaatcatcgtgctaaagattcaactccagattatcacaaagaaagtttcaagacttcagaggtaccgtcagctatttttggcacaatgaaacctaaaaagttagaaaatggtcgtatccctgtaagtaaaccttcagaaaaagttgagtcagataaacaaaaatatgataaatatgtagctaagacgcaaacgtctcaaaataaacaattagaacaagaaaaacaaaatgatagtgttgtcaaacaaggaactgcatctaaatcatctgatgaaaatgtatcatcaacaacaaaatcaatgcctaattattcaaaagttgataatactatcaaaattgaaaatatttatgcttcacaaattgttgaagaaattagacgtgaacgagaacgtaaagtgcttcaaaagcgtcgatttaaaaaagcgttgcaacaaaagcgtgaagaacataaaaacgaagagcaagatgcaatacaacgtgcaattgatgaaatgtatgctaaacaagcggaacgctatgttggtgatagttcattaaatgatgatagtgacttaacagataatagtacagatgctagtcagcttcatacaaatggcatagagaatgaaactgtatcaaatgatgaaaataaacaagcgtcaatacaaaatgaagacactaatgacactcatgtagatgaaagtccatacaattatgaggaagttagtttgaatcaagtatcgacaacaaaacaattgtcagatgatgaagttacggtttcgaatgtaacgtctcaacatcaatcagcactacaacataacgttgaagtaaatgataaagatgaactaaaaaatcaatccagattaattgctgattcagaagaagatggagcaacgaataaagaagaatattcaggaagtcaaatcgatgatgcagaattttatgaattaaatgatacagaagtagatgaggatactacttcaaatatcgaagataataccaatagaaacgcgtctgaaatgcatgtagacgctcctaaaacgcaagagtacgcagtaactgaatctcaagtaaataatatcgataaaacggttgataatgaaattgaattagcaccgcgtcataaaaaagatgaccaaacaaacttaagtgtcaactcattgaaaacgaatgatgtgaatgataatcatgttgtggaagattcaagcatgaatgaaatagaaaagaataacgcagaaattacagaaaatgtgcaaaacgaagcagctgaaagtgaacaaaatgtcgaagagaaaactattgaaaacgtaaatccaaagaaacagactgaaaaggtttcaactttaagtaaaagaccatttaatgttgtcatgacgccatctgataaaaagcgtatgatggatcgtaaaaagcattcaaaagtcaatgtgcctgaattaaagcctgtacaaagtaagcaagctgtgagtgaaagaatgcctgcgagtcaagccacaccatcatcaagatctgattcacaagagtcaaatacaaatgcatataaaacaaataatatgacatcaaacaatgttgagaacaatcaacttattggtcatgcagaaacagaaaatgattatcaaaatgcacaacaatattcagagcagaaaccttctgttgattcaactcaaacggaaatatttgaagaaagtcaagatgataatcaattggaaaatgagcaagttgatcaatcaacttcgtcttcagtttcagaagtaagcgacataactgaagaaagcgaagaaacaacacatccaaacaatactagtggacaacaagataatgatgatcaacaaaaagatttacagtcatcattttcaaataaaaatgaagatacagctaatgaaaatagacctcggacgaaccaacaagatgttgcaacaaatcaagctgtacaaacatctaagccgatgattcgtaaaggcccaaatattaaattgccaagtgtttcattactagaagaaccacaagttattgagtcggacgaggactggattacagataaaaagaaagaactgaatgacgcattattttactttaatgtacctgcagaagtacaagatgtaactgaaggtccaagtgttacaagatttgaattatcagttgaaaaaggtgttaaagtttcaagaattacggcattacaagatgacattaaaatggcattggcagcgaaagatattcgtatagaagcgcctattccaggaactagtcgtgttggtattgaagttccgaaccaaaatccaacgacagtcaacttacgttctattattgaatctccaagttttaaaaatgctgaatctaaattaacagttgcgatggggtatagaattaataatgaaccattacttatggatattgctaaaacgccacacgcactaattgcaggtgcaactggatcagggaaatcagtttgtatcaatagtattttgatgtctttactatataaaaatcatcctgaggaattaagattattacttatcgatccaaaaatggttgaattagctccttataatggtttgccacatttagttgcaccggtaattacagatgtcaaagcagctacacagagtttaaaatgggccgtagaagaaatggaacgacgttataagttatttgcacattaccatgtacgtaatataacagcatttaacaaaaaagcaccatatgatgaaagaatgccaaaaattgtcattgtaattgatgagttggctgatttaatgatgatggctccgcaagaagttgaacagtctattgctagaattgctcaaaaagcgagagcatgtggtattcatatgttagtagctacgcaaagaccatctgtcaatgtaattacaggtttaattaaagccaacataccaacaagaattgcatttatggtatcatcaagtgtagattcgagaacgatattagacagtggtggagcagaacgcttgttaggatatggcgatatgttatatcttggtagcggtatgaataaaccgattagagttcaaggtacatttgtttctgatgacgaaattgatgatgttgttgattttatcaaacaacaaagagaaccggactatctatttgaagaaaaagaattgttgaaaaaaacacaaacacaatcacaagatgaattatttgatgatgtttgtgcatttatggttaatgaaggacatatttcaacatcattaatccaaagacatttccaaattggctataatagagcagcaagaattatcgatcaattagagcaactcggttatgtttcgagtgctaatggttcaaaaccaagggatgtttatgttacggaagcagatttaaataaagaa

SEQ ID NO: 144 - DNA, 3171 bp, Staphylococcus aureus
atgcctaaacgtaatgatatcaaaacaattttagtaatagggtctgggccaattatcataggtcaagcagctgaatttgattatgctggaacacaagcatgtctagctttaaaagaagagggatatcgagttattcttgtaaattcaaatccagcgacaatcatgactgataaggaaattgcggataaagtatatatcgaaccgttaactcatgattttatagcgcgaattatacgtaaagagcaacctgacgctttacttccaactttaggtggtcaaacaggtttaaacatggcgattcaactacacgaaagtggtgtgcttcaagataataacgtccaattattaggaactgagctaacatcaattcaacaagcagaagaccgtgaaatgtttagaacattaatgaatgatttaaacgttcctgtaccagagagtgacattgtaaatacagtagagcaagcctttaaattcaaagagcaagtgggatacccgctaattgttagaccggcatttacgatgggtggtaccggaggcggtatttgtcataatgatgaagaattacatgaaatcgtctcaaatggtcttcattatagtccagcaacgcaatgtttattagaaaaatctatcgcaggttttaaagaaatcgaatacgaagtaatgcgtgataaaaacgataatgccatcgttgtatgtaacatggaaaatattgatccagttggtattcatacaggcgattcaattgttgtggctcctagtcaaacattatcagatgttgagtatcaaatgttacgtgatgtttcattaaaagttattcgagctttaggtatcgaaggtggttgtaatgttcaattagcattagatccccattcattcgattattatattatagaagtaaatccgcgtgtatcacgttcatcagcgttagcttcaaaagcaacaggatatcctattgcaaaattagctgctaaaatcgcggttggtctaacattagatgaaatgttaaatccaattacaggaacatcttatgcagcgtttgaaccaactttagactatgtgatttcaaaaataccaagatttccttttgataaatttgaaaaaggagaacgagagcttggcacacaaatgaaagcaacaggtgaagttatggccattggtcgaacttacgaagaatcattgttaaaagcaattcgatcacttgagtatggtgtgcatcacttaggattaccaaatggtgaaagcttcgatcttgattatattaaagaacgtatttcacaccaagatgatgaacgattatttttcatcggcgaagcaattagaagaggcacaacattagaagaaattcataatatgactcagattgattacttcttcttacacaagttccaaaacattattgatattgagcatcaattaaaagagcatcaaggtgatttagaatatcttaaatatgcaaaagattatggatttagtgataaaacaatagcgcatcgctttaatatgacggaagaagaagtatatcaattgcgtatggaaaatgatattaaacctgtttacaagatggttgatacttgcgcagctgaatttgaatcttcaacaccatattattatggtacatacgaaactgaaaatgaatccatagttactgacaaagaaaaaatcttagtattaggctctggaccaattcgaatcggccaaggtgtagaatttgactatgcgacagttcatgccgtttgggcaattcaaaaagcagggtacgaagcgataattgtgaataacaatccagaaacagtttcaacagacttctcaatttctgacaaattatactttgaacctttaactgaagaagatgtgatgaatatcattaatttagaaaaacctaaaggtgtcgttgtacaatttggaggacaaacagcgattaatttagcagacaaattggctaaacatggtgttaaaatacttggtacttcactagaaaatctaaatcgtgctgaagatagaaaagaatttgaagcactattaagaaaaattaacgtgccacagccacaagggaaaacagctacatcacctgaggaagcattagcgaatgctgcagaaatcggatatccggttgtagtaagaccttcttatgtattaggtggtcgcgcaatggaaattgtagacaatgacaaagagttagaaaactatatgacccaggctgtaaaagcgagtccggaacatccggtactagtcgatagatatttaactggtaaagaaattgaagttgatgcgatttgtgatggagaaacggtcattattccaggaatcatggaacatattgaacgtgctggtgtgcatagtggtgactcaatcgctgtatatccaccacaaactttgacagaagacgagttagcaacacttgaggactatactataaaattagctaaaggtttaaacatcattggcttaatcaacattcaattcgttatagctcacgatggtgtgtatgttttagaagtaaatccacgttctagtagaacggtaccattcttaagtaaaattactgatattccaatggcacaattagctatgcgagcaatcattggggaaaaactaacagatatgggttatcaagaaggggttcaaccatatgctgagggtgtctttgtgaaagcaccagtatttagttttaataaattgaaaaatgttgatattactttaggacctgaaatgaagtcaacaggtgaagtgatggggaaagatactacattagaaaaggcgttattcaaagggttaacaggtagtggcgttgaagttaaagatcacggtacagtattaatgaccgtcagtgacaaagataaagaggaagttgttaaattggcacaacgcttaaatgaagttggctataaaattttagcaacgtctggaacagctaataaattagctgagtatgacatacctgcagaagtagtaggcaaaattggtggcgaaaatgatttattaacacgtattcaaaatggtgatgttcaaatcgttataaatacaatgactaaaggtaaagaagtagaaagggatggcttccaaattagacgtactacagttgaaaatggtattccatgtttgacatctttagatacagctaatgccttaacgaatgtaattgaaagtatgacatttacaatgcgtcaaatg

SEQ ID NO: 145 - DNA, 3498 bp, Staphylococcus aureus
atgattaacagggataataaaaaggcaataacaaaaaagggtatgatttcaaatcgcttaaacaaattttcgattagaaagtatactgtaggaactgcatcgattttagtaggtacgacattgatttttggtctagggaaccaagaagctaaagctgctgaaaacactagtacagaaaatgcaaaacaagatgatgcaacgactagtgataataaagaagtagtgtcggaaactgaaaataattcgacaacagaaaataattcaacaaatccaattaagaaagaaacaaatactgattcacaaccagaagctaaaaaagaatcaacttcatcaagtactcaaaaacagcaaaataacgttacagctacaactgaaactaagcctcaaaacattgaaaaagaaaatgttaaaccttcaactgataaaactgcgacagaagatacatctgttattttagaagagaagaaagcaccaaataatacaaataacgatgtaactacaaaaccatctacaagtgaaccatctacaagtgaaattcaaacaaaaccaactacacctcaagaatctacaaatattgaaaattcacaaccgcaaccaacgccttcaaaagtagacaatcaagttacagatgcaactaatccaaaagaaccagtaaatgtgtcaaaagaagaacttaaaaaaaatcctgagaaattaaaagaattggttagaaatgatagcaatacagatcattcaactaaaccagttgctacagctccaacaagtgttgcaccaaaacgtgtaaacgcaaaaatgcgctttgcagttgcacaaccagcagcagttgcttcaaacaatgtaaatgatttaattaaagtgacgaagcaaacaatcaaagttggcgatggtaaagataatgtggcagcagcgcatgacggtaaagatattgaatatgatacagagtttacaattgacaataaagtcaaaaaaggcgatacaatgacgattaattatgataagaatgtaattccttcggatttaacagataaaaatgatcctatcgatattactgatccatcaggagaggtcattgctaaaggaacatttgataaagcaactaagcaaatcacatatacatttacagactatgtagataaatatgaagatataaaatcacgcttaactctatattcgtatattgataaaaaaacagttccaaatgagacaagtttgaatttaacatttgctacagcaggtaaagaaacaagccaaaatgtcactgttgattatcaagatccaatggtccatggtgattcaaacattcaatctatctttacaaaattagatgaagataagcaaactattgaacaacaaatttatgttaacccattgaaaaaatcagcaaccaacactaaagttgatatagctggtagtcaagtagatgattatggaaatattaaactaggaaatggtagcaccattattgaccaaaatacagaaataaaggtttataaagttaactctgatcaacaattgcctcaaagtaatagaatctatgattttagtcaatacgaagatgtaacaagtcaatttgataataaaaaatcatttagtaataatgtagcaacattggattttggtgatattaattcagcctatattatcaaagttgttagtaaatatacacctacatcagatggcgaactagatattgcccaaggtactagtatgagaacaactgataaatatggttattataattatgcaggatattcaaacttcatcgtaacttctaatgacactggcggtggcgacggtactgttaaacctgaagaaaagttatacaaaattggtgactatgtatgggaagacgttgataaagacggtgttcaaggtacagattcaaaagaaaaaccaatggcaaacgttttagttacattaacttacccggacggtactacaaaatcagtaagaacagatgctaatggtcattatgaattcggtggtttgaaagacggagaaacttatacagttaaattcgaaacgccaactggatatcttccaacaaaagtaaatggaacaactgatggtgaaaaagactcaaatggtagttcggttactgttaaaattaatggtaaagatgatatgtctttagatactggtttttacaaagaacctaaatacaacttaggtgactatgtatgggaagatactaataaagatggtatccaagatgcaaatgagccaggaatcaaagatgttaaggttacattaaaagatagtactggaaaagttattggtacaactactactgatgcctcgggtaaatataaatttacagatttagataatggtaactatacagtagaatttgaaacaccagcaggttacacgccaacggttaaaaatactacagctgatgataaagattctaatggtttaacaacaacaggtgtcattaaagatgcagataatatgacattagacaggggtttctataaaacaccaaaatacagtttaggtgattatgtttggtacgacagtaataaagacggcaaacaagattcaactgaaaaaggtatcaaagatgtgacagttacattgcaaaacgaaaaaggcgaagtaattggaacaactaaaacagatgaaaatggtaaatatcgtttcgataatttagatagcggtaaatacaaagttatttttgaaaagcctgctggcttaacacaaacagttacaaatacaactgaagatgataaagatgcagatggtggcgaagttgacgtaacaattacggatcatgatgatttcacacttgataacggatacttcgaagaagatacatcagacagcgattcagactcagatagtgactcagacagcgactcagactcagacagcgactcagactcagacagtgattcagattcagacagcgactcagattcagatagcgactcagattcggacagcgattcagactcagatagcgactcagattcagatagcgattcagactcagacagcgactcagattcagatagcgattcggactcagacagcgattcagactcagatagcgactcagactcagacagcgactcagattcagatagcgattcggactcagatagcgactcagattcagacagcgattcagactcagatagcgactcagattcagacagcgattcagactcagatagcgactcagactcagacagtgattcagattcagacagcgactcagactcagatagcgactcagattcggacagcgactcagactcagatagcgactcagactcagacagtgattcagacagcgattcagactcggatgcaggaaaacatacacctgttaaaccaatgagtactactaaagaccatcacaataaagcaaaagcattaccagaaacaggtagtgaaaataacggctcaaataacgcaacgttatttggtggattatttgcagcattaggttcattattgttattcggtcgtcgcaaaaaacaaaacaaa

SEQ ID NO: 146 - DNA, 372 bp, Staphylococcus aureus
atgactcatttattagagacatttgagatgtcaatagatcaccaggaagatggtttagttgttatttctatgcctgttactgataaagtaaaacaaccatttggatatttacatggtggggcttcgattgctttaggtgaaacagcatgttcattaggatctgctaatttaattgatacaaccaaatttattccattaggtttagagatgaatgctaaccatattcattctgctaaagatggtcgtgttactgcgacagctgaaattattcatcgaggtaagtcgacacatgtatgggatataaaaattaagaatgacaaagaacaattaattacagttatgcgtggtacagttgctattaaacctttaaaa

SEQ ID NO: 147 - DNA, 939 bp, Staphylococcus aureus
atggagcatacaactatgaaaataacaacgattgctaaaacaagtttagcactaggccttttaacaacaggtgtaatcacaacgacaacgcaagcagcaaacgcgacaacaccatcttccactaaagtggaagcaccacaatcaacaccgccctcaactaaaatagaagcaccgcaatcaaaaccaaacgcgacaacaccgccctcaactaaagtagaagcaccgcaacaaacagcaaatgcgacaacaccgccttcaactaaagtgacaacacctccatcaacaaacacgccacaaccaatgcaatctactaaatcagacacaccacaatcgccaaccacaaaacaagtaccaacagaaataaatcctaaatttaaagatttaagagcgtattatacgaaaccaagtttagaatttaaaaatgagattggtattattttaaaaaaatggacgacaataagatttatgaatgttgtcccagattatttcatatataaaattgctttagttggtaaagatgataaaaaatatggtgaaggagtacataggaatgtcgatgtatttgtcgttttagaagaaaataattacaatctggaaaaatattctgtcggtggtatcacaaagagtaatagtaaaaaagttgatcacaaagcaggagtaagaattactaaggaagataataaaggtacaatctctcatgatgtttcagaattcaagattactaaagaacagatttccttgaaagaacttgattttaaattgagaaaacaacttattgaaaaaaataatctgtacggtaacgttggttcaggtaaaattgttattaaaatgaaaaacggtggaaagtacacgtttgaattgcacaaaaaattacaagaaaatcgcatggcagatgtcattaatagtgaacaaattaaaaacatcgaagtgaatttgaaa

SEQ ID NO: 148 - DNA, 1908 bp, Staphylococcus aureus
atgaaaaagcaaataatttcgctaggcgcattagcagttgcatctagcttatttacatgggataacaaagcagatgcgatagtaacaaaggattatagtgggaaatcacaagttaatgctgggagtaaaaatgggacattaatagatagcagatatttaaattcagctctatattatttggaagactatataatttatgctataggattaactaataaatatgaatatggagataatatttataaagaagctaaagataggttgttggaaaaggtattaagggaagatcaatatcttttggagagaaagaaatctcaatatgaagattataaacaatggtatgcaaattataaaaaagaaaatcctcgtacagatttaaaaatggctaattttcataaatataatttagaagaactttcgatgaaagaatacaatgaactacaggatgcattaaagagagcactggatgattttcacagagaagttaaagatattaaggataagaattcagacttgaaaacttttaatgcagcagaagaagataaagcaactaaggaagtatacgatctcgtatctgaaattgatacattagttgtatcatattatggtgataaggattatggggagcacgcgaaagagttacgagcaaaactggacttaatccttggagatacagacaatccacataaaattacaaatgaacgtattaaaaaagaaatgattgatgacttaaattcaattattgatgatttctttatggaaactaaacaaaatagaccgaaatctataacgaaatataatcctacaacacataactataaaacaaatagtgataataaacctaattttgataaattagttgaagaaacgaaaaaagcagttaaagaagcagatgattcttggaaaaagaaaactgtcaaaaaatacggagaaactgaaacaaaatcgccagtagtaaaagaagagaagaaagttgaagaacctcaagcacctaaagttgataaccaacaagaggttaaaactacggctggtaaagctgaagaaacaacacaaccagttgcacaaccattagttaaaattccacagggcacaattacaggtgaaattgtaaaaggtccggaatatccaacgatggaaaataaaacggtacaaggtgaaatcgttcaaggtcccgattttctaacaatggaacaaagcggcccatcattaagcaataattatacaaacccaccgttaacgaaccctattttagaaggtcttgaaggtagctcatctaaacttgaaataaaaccacaaggtactgaatcaacgttaaaaggtactcaaggagaatcaagtgatattgaagttaaacctcaagcaactgaaacaacagaagcttctcaatatggtccgagaccgcaatttaacaaaacacctaaatatgttaaatatagagatgctggtacaggtatccgtgaatacaacgatggaacatttggatatgaagcgagaccaagattcaataagccatcagaaacaaatgcatataacgtaacaacacatgcaaatggtcaagtatcatacggagctcgtccgacatacaagaagccaagcgaaacgaatgcatacaatgtaacaacacatgcaaacggccaagtatcatacggagctcgtccgacacaaaacaagccaagcaaaacaaacgcatataacgtaacaacacatggaaacggccaagtatcatatggcgctcgcccaacacaaaacaagccaagcaaaacaaatgcatacaacgtaacaacacatgcaaacggtcaagtgtcatacggagctcgcccgacatacaagaagccaagtaaaacaaatgcatacaatgtaacaacacatgcagatggtactgcgacatatgggcctagagtaacaaaa

SEQ ID NO: 149 - DNA, 723 bp, Staphylococcus aureus
atgaaaaaattagcaacagtaggttctttaattgtaacaagcactttagtattctcaagtatgccttttcaaaatgcgcatgccgacacaacttcaatgaatgtgtcgaataaacaaagccaaaatgtacaaaatcatcgtccttatggcggagtagtaccacaaggaatgacgcaagcacaatatactgaattagagaaagctttaccccaattaagcgctggcagtaatatgcaagactataatatgaaattgtatgatgcgacgcaaaatattgctgataaatacaatgtgataattacaactaatgtaggggtatttaaaccacatgctgttagagatatgaatggccatgcgttacctttaacaaaagatggcaatttttatcaaacgaatgtagatgcaaatggtgttaatcatggtggtagtgaaatggtgcaaaataaaacaggtcatatgagtcaacaaggccatatgaatcagaacacacacatgaaccaacagccacacatgcaacaaggtcatatgcaatcatcaaaccatcaaatgatgagtccaaaagcaaatatgcattcatcaaatcatcaaatgaaccaaagtaacaaaaaagttttaccagctgctggtgaaagtatgacatcaagtattcttactgcaagtattgccgcactactattagtatctgggttattcttagcatttagacgacgttcaacaaataaa

SEQ ID NO: 150 - DNA, 1149 bp, Staphylococcus aureus
gtgcttaggagtgatttttatatgtcttattccattgttagagtttcaaaagttaaatctggaacaaatacaacgggcatacaaaaacatgttcaaagagaaaataataattatgaaaatgaagatatagaccatagtaaaacttacttaaattatgatttggtaaatgctaataaacagaattttaataacttgattgatgaaaaaatcgaacagaattatacaggcaaaagaaaaattagaacagacgcgattaaacacattgatggtttaattacatcagacaatgatttctttgataatcaaacgccagaagatacaaagcagttttttgaatatgctaaagagtttttagaacaagaatacggtaaagataatttattatatgcaacagttcacatggacgaaaaaacaccacatatgcattatggcgttgttccaataactgatgatggtcgtttaagtgctaaagaagttgtaggtaataaaaaagctttaacagcgtttcaagatagatttaatgagcatgttaaacaacgaggatatgatttagaacgtgggcaatcaagacaagtaacaaatgctaaacatgagcaaataagtcagtataaacaaaaaacagaatatcataagcaagaatatgaacgtgagagccaaaaaacagaccatataaagcaaaagaacgataaattaatgcaagagtaccaaaaatcgttaaatacgcttaaaaagcctataaatgttccgtatgagcaagaaactgaaaaagtaggtggtttatttagcaaagaaatacaagaaactggaaatgttgtaataagccaaaaagatttcaatgaatttcagaaacagataaaagctgctcaagatatttcggaagattacgagtatataaagtctggtagagccttagatgataaagataaggaaatacgagagaaagatgatttattaaataaagcagttgagcgtattgaaaacgcagacgataattttaaccaactttacgaaaatgcaaagccacttaaagagaatatagaaatagcgttaaagcttttaaaaatcttactaaaagagttagaacgagttttaggaagaaatacctttgcggaaagagttaataagttaacagaagatgaacctatggca

SEQ ID NO: 151 - protein, 1274 aa, Staphylococcus aureus
MSWFDKLFGEDNDSNDDLIHRKKKRRQESQNIDNDHDSLLPQNNDIYSRPRGKFRFPMSVAYENENVEQSADTISDEKEQYHRDYRKQSHDSRSQKRHRRRRNQTTEEQNYSEQRGNSKISQQSIKYKDHSHYHTNKPGTYVSAINGIEKETHKPKTHNMYSNNTNHRAKDSTPDYHKESFKTSEVPSAIFGTMKPKKLENGRIPVSKPSEKVESDKQKYDKYVAKTQTSQNKQLEQEKQNDSVVKQGTASKSSDENVSSTTKSMPNYSKVDNTIKIENIYASQIVEEIRRERERKVLQKRRFKKALQQKREEHKNEEQDAIQRAIDEMYAKQAERYVGDSSLNDDSDLTDNSTDASQLHTNGIENETVSNDENKQASIQNEDTNDTHVDESPYNYEEVSLNQVSTTKQLSDDEVTVSNVTSQHQSALQHNVEVNDKDELKNQSRLIADSEEDGATNKEEYSGSQIDDAEFYELNDTEVDEDTTSNIEDNTNRNASEMHVDAPKTQEYAVTESQVNNIDKTVDNEIELAPRHKKDDQTNLSVNSLKTNDVNDNHVVEDSSMNEIEKNNAEITENVQNEAAESEQNVEEKTIENVNPKKQTEKVSTLSKRPFNVVMTPSDKKRMMDRKKHSKVNVPELKPVQSKQAVSERMPASQATPSSRSDSQESNTNAYKTNNMTSNNVENNQLIGHAETENDYQNAQQYSEQKPSVDSTQTEIFEESQDDNQLENEQVDQSTSSSVSEVSDITEESEETTHPNNTSGQQDNDDQQKDLQSSFSNKNEDTANENRPRTNQQDVATNQAVQTSKPMIRKGPNIKLPSVSLLEEPQVIESDEDWITDKKKELNDALFYFNVPAEVQDVTEGPSVTRFELSVEKGVKVSRITALQDDIKMALAAKDIRIEAPIPGTSRVGIEVPNQNPTTVNLRSIIESPSFKNAESKLTVAMGYRINNEPLLMDIAKTPHALIAGATGSGKSVCINSILMSLLYKNHPEELRLLLIDPKMVELAPYNGLPHLVAPVITDVKAATQSLKWAVEEMERRYKLFAHYHVRNITAFNKKAPYDERMPKIVIVIDELADLMMMAPQEVEQSIARIAQKARACGIHMLVATQRPSVNVITGLIKANIPTRIAFMVSSSVDSRTILDSGGAERLLGYGDMLYLGSGMNKPIRVQGTFVSDDEIDDVVDFIKQQREPDYLFEEKELLKKTQTQSQDELFDDVCAFMVNEGHISTSLIQRHFQIGYNRAARIIDQLEQLGYVSSANGSKPRDVYVTEADLNKE

SEQ ID NO: 152 - protein, 1057 aa, Staphylococcus aureus
MPKRNDIKTILVIGSGPIIIGQAAEFDYAGTQACLALKEEGYRVILVNSNPATIMTDKEIADKVYIEPLTHDFIARIIRKEQPDALLPTLGGQTGLNMAIQLHESGVLQDNNVQLLGTELTSIQQAEDREMFRTLMNDLNVPVPESDIVNTVEQAFKFKEQVGYPLIVRPAFTMGGTGGGICHNDEELHEIVSNGLHYSPATQCLLEKSIAGFKEIEYEVMRDKNDNAIVVCNMENIDPVGIHTGDSIVVAPSQTLSDVEYQMLRDVSLKVIRALGIEGGCNVQLALDPHSFDYYIIEVNPRVSRSSALASKATGYPIAKLAAKIAVGLTLDEMLNPITGTSYAAFEPTLDYVISKIPRFPFDKFEKGERELGTQMKATGEVMAIGRTYEESLLKAIRSLEYGVHHLGLPNGESFDLDYIKERISHQDDERLFFIGEAIRRGTTLEEIHNMTQIDYFFLHKFQNIIDIEHQLKEHQGDLEYLKYAKDYGFSDKTIAHRFNMTEEEVYQLRMENDIKPVYKMVDTCAAEFESSTPYYYGTYETENESIVTDKEKILVLGSGPIRIGQGVEFDYATVHAVWAIQKAGYEAIIVNNNPETVSTDFSISDKLYFEPLTEEDVMNIINLEKPKGVVVQFGGQTAINLADKLAKHGVKILGTSLENLNRAEDRKEFEALLRKINVPQPQGKTATSPEEALANAAEIGYPVVVRPSYVLGGRAMEIVDNDKELENYMTQAVKASPEHPVLVDRYLTGKEIEVDAICDGETVIIPGIMEHIERAGVHSGDSIAVYPPQTLTEDELATLEDYTIKLAKGLNIIGLINIQFVIAHDGVYVLEVNPRSSRTVPFLSKITDIPMAQLAMRAIIGEKLTDMGYQEGVQPYAEGVFVKAPVFSFNKLKNVDITLGPEMKSTGEVMGKDTTLEKALFKGLTGSGVEVKDHGTVLMTVSDKDKEEVVKLAQRLNEVGYKILATSGTANKLAEYDIPAEVVGKIGGENDLLTRIQNGDVQIVINTMTKGKEVERDGFQIRRTTVENGIPCLTSLDTANALTNVIESMTFTMRQM

SEQ ID NO: 153 - protein, 1166 aa, Staphylococcus aureus
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKKNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDRGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 154 - protein, 124 aa, Staphylococcus aureus
MTHLLETFEMSIDHQEDGLVVISMPVTDKVKQPFGYLHGGASIALGETACSLGSANLIDTTKFIPLGLEMNANHIHSAKDGRVTATAEIIHRGKSTHVWDIKIKNDKEQLITVMRGTVAIKPLK

SEQ ID NO: 155 - protein, 313 aa, Staphylococcus aureus
MEHTTMKITTIAKTSLALGLLTTGVITTTTQAANATTPSSTKVEAPQSTPPSTKIEAPQSKPNATTPPSTKVEAPQQTANATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVINSEQIKNIEVNLK

SEQ ID NO: 156 - protein, 636 aa, Staphylococcus aureus
MKKQIISLGALAVASSLFTWDNKADAIVTKDYSGKSQVNAGSKNGTLIDSRYLNSALYYLEDYIIYAIGLTNKYEYGDNIYKEAKDRLLEKVLREDQYLLERKKSQYEDYKQWYANYKKENPRTDLKMANFHKYNLEELSMKEYNELQDALKRALDDFHREVKDIKDKNSDLKTFNAAEEDKATKEVYDLVSEIDTLVVSYYGDKDYGEHAKELRAKLDLILGDTDNPHKITNERIKKEMIDDLNSIIDDFFMETKQNRPKSITKYNPTTHNYKTNSDNKPNFDKLVEETKKAVKEADDSWKKKTVKKYGETETKSPVVKEEKKVEEPQAPKVDNQQEVKTTAGKAEETTQPVAQPLVKIPQGTITGEIVKGPEYPTMENKTVQGEIVQGPDFLTMEQSGPSLSNNYTNPPLTNPILEGLEGSSSKLEIKPQGTESTLKGTQGESSDIEVKPQATETTEASQYGPRPQFNKTPKYVKYRDAGTGIREYNDGTFGYEARPRFNKPSETNAYNVTTHANGQVSYGARPTYKKPSETNAYNVTTHANGQVSYGARPTQNKPSKTNAYNVTTHGNGQVSYGARPTQNKPSKTNAYNVTTHANGQVSYGARPTYKKPSKTNAYNVTTHADGTATYGPRVTK

SEQ ID NO: 157 - protein, 241 aa, Staphylococcus aureus
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGVNHGGSEMVQNKTGHMSQQGHMNQNTHMNQQPHMQQGHMQSSNHQMMSPKANMHSSNHQMNQSNKKVLPAAGESMTSSILTASIAALLLVSGLFLAFRRRSTNK

SEQ ID NO: 158 - protein, 383 aa, Staphylococcus aureus
VLRSDFYMSYSIVRVSKVKSGTNTTGIQKHVQRENNNYENEDIDHSKTYLNYDLVNANKQNFNNLIDEKIEQNYTGKRKIRTDAIKHIDGLITSDNDFFDNQTPEDTKQFFEYAKEFLEQEYGKDNLLYATVHMDEKTPHMHYGVVPITDDGRLSAKEVVGNKKALTAFQDRFNEHVKQRGYDLERGQSRQVTNAKHEQISQYKQKTEYHKQEYERESQKTDHIKQKNDKLMQEYQKSLNTLKKPINVPYEQETEKVGGLFSKEIQETGNVVISQKDFNEFQKQIKAAQDISEDYEYIKSGRALDDKDKEIREKDDLLNKAVERIENADDNFNQLYENAKPLKENIEIALKLLKILLKELERVLGRNTFAERVNKLTEDEPMA

SEQ ID NO: 159 - DNA, 2631 bp, Staphylococcus aureus
atgatgaaaaagttaaaagcgagtgaaattagacaaaaatatctagatttctttgttgaaaaaggacatatggttgaaccttctgcaccattagtgccaattgatgatgatacattattatggattaattcaggtgtagcaacattaaagaaatattttgatggacgtgaaacacctaaaaagccaagaattgtaaactctcaaaaagctattcgtacaaatgatattgaaaatgttggtttcacagcgcgtcaccatacattctttgaaatgttaggtaacttctcaattggtgattattttaaacaagaagcgattgaatttgcttgggaatttttaacgagtgataaatggatgggtatggagccagataaattgtacgttacgattcatccggaagatatggaagcatacaacatttggcataaagatattgggcttgaagaaagtcgtattattcgcattgaaggtaacttctgggatattggtgaagggccttcaggaccgaacactgagattttctatgatcgcggagaagcatatggacaagacgatccggcagaagaaatgtatccaggtggagaaaatgaacgctatcttgaagtatggaacttagtatttagtgaattcaatcataataaagatcatagttacacaccattacctaataaaaatattgatactggcatggggcttgagcgtatggcctcagtttctcaaaatgtacgtactaactatgaaacagatttatttatgcctataatgaatgaaatcgaaaaagtatcaggtaaacaatatttagtaaacaacgaacaagatgtggcatttaaagtaattgctgaccacattcgtacgattgcatttgcaatttctgatggtgcattacctgccaatgaaggtagagggtatgtattacgtcgattgttacgtcgtgccgttcgttttagtcaaacgttaggaatcaatgagccatttatgtacaaacttgttgatattgttgcagacattatggaaccatattatccaaatgttaaggaaaaagcagatttcattaagcgtgttataaagtctgaagaagaacgattccatgaaacattagaagatggtttagcgattttaaatgaattaattaaaaaagctaaagcgacaacaaatgaaattaatgggaaagatgcatttaaattgtatgatacgtatgggttcccaattgaattaactgaagaaatagcagtgcaagcaggattgaaagttgatatgacaacattcgagtcagaaatgcaacaacaacgtgatcgtgcacgtcaagcacgtcaaaattctcaatcaatgcaagttcaaagtgaagtattgaaaaatattacatctgcaagtacttttgttggttatgatactgcgacagctcaaacaacactaacacacttgatatacaatggtgaagaagtttcacaagttgaagcgggtgaaacagtatacttcatgttaacggaaacaccattttatgcaatcagtggtggacaagttgcggatacaggtattgtttataatgacaattttgaaattgctgttagtgaagtaaccaaagcaccaaatggtcaaaacttgcataaaggagtagtacaatttggccaagtaaatgttggcgctacagtgtctgctgaagtgaaccaaaatgatcgacgtgacattcaaaagaaccatagtgcaacacatttattacatgcagcgttgaaatcagtactgggtgatcatgttaaccaagctggttcactagtagaagcagatcgtttacgttttgatttctctcattttggtccaatgactaatgatgaaattgatcaagttgaacgcttagtaaatgaagaaatttggaaaggtattgacgttaacattcaagaaatggatattgcttcagctaaagaaatgggcgcaatggcattattcggtgaaaaatatggtgatgttgtgcgtgtagtaaatatggcaccattttcaattgaattatgtggtggtattcatgtccgcaatacttctgaaattggcttattcaaaatagtaagtgagtcaggtacaggagctggtgtgcgtcgtattgaagcattaacaggtaaagcagctttcttatatttagaagatattcaagagaaatttaatacgatgaaatcacagctgaaagtgaaatctgatgatcaagtagtcgataagttaacacaattacaagatgaagaaaaagcattattaaaacaattagagcaacgtgacaaagaaatcacatcacttaaaatgggtaatattgaagatcaagttgaagaaatcaatggctataaagtattggttactgaagtggatgtaccaaatgcgaaagcaattcgctcgacaatggacgattttaaatctaaactacaagatacaattatcattcttgcaagtaatgttgatgataaagtatcgatggttgcaactgtccctaaatctttaacaaataacgttaaagccggtgatcttatcaaacaaatggcaccaatcgttggtggtaaaggtggcggtcgtccagatatggctcaaggtggcggtacacaacctgaaaatatctcaaaatcattaagctttattaaagattacattaaaaatcta

SEQ ID NO: 160 - protein, 877 aa, Staphylococcus aureus
MMKKLKASEIRQKYLDFFVEKGHMVEPSAPLVPIDDDTLLWINSGVATLKKYFDGRETPKKPRIVNSQKAIRTNDIENVGFTARHHTFFEMLGNFSIGDYFKQEAIEFAWEFLTSDKWMGMEPDKLYVTIHPEDMEAYNIWHKDIGLEESRIIRIEGNFWDIGEGPSGPNTEIFYDRGEAYGQDDPAEEMYPGGENERYLEVWNLVFSEFNHNKDHSYTPLPNKNIDTGMGLERMASVSQNVRTNYETDLFMPIMNEIEKVSGKQYLVNNEQDVAFKVIADHIRTIAFAISDGALPANEGRGYVLRRLLRRAVRFSQTLGINEPFMYKLVDIVADIMEPYYPNVKEKADFIKRVIKSEEERFHETLEDGLAILNELIKKAKATTNEINGKDAFKLYDTYGFPIELTEEIAVQAGLKVDMTTFESEMQQQRDRARQARQNSQSMQVQSEVLKNITSASTFVGYDTATAQTTLTHLIYNGEEVSQVEAGETVYFMLTETPFYAISGGQVADTGIVYNDNFEIAVSEVTKAPNGQNLHKGVVQFGQVNVGATVSAEVNQNDRRDIQKNHSATHLLHAALKSVLGDHVNQAGSLVEADRLRFDFSHFGPMTNDEIDQVERLVNEEIWKGIDVNIQEMDIASAKEMGAMALFGEKYGDVVRVVNMAPFSIELCGGIHVRNTSEIGLFKIVSESGTGAGVRRIEALTGKAAFLYLEDIQEKFNTMKSQLKVKSDDQVVDKLTQLQDEEKALLKQLEQRDKEITSLKMGNIEDQVEEINGYKVLVTEVDVPNAKAIRSTMDDFKSKLQDTIIILASNVDDKVSMVATVPKSLTNNVKAGDLIKQMAPIVGGKGGGRPDMAQGGGTQPENISKSLSFIKDYIKNL

SEQ ID NO: 161 - DNA, 1722 bp, Staphylococcus aureus
atgaatagtgagtttatatatggacgggtaacaaatttaggaggtaagattttgagtttaataaagaaaaagaataaagatattcgcattataccattaggcggtgttggcgaaattgctaaaaatatgtatatcgttgaagtagacgatgaaatgtttatgttagatgctggacttatgtttccagaagacgaaatgctaggtattgatattgttataccagacatttcatacgtacttgaaaataaagataaattgaagggtatattccttacacacggacatgagcacgcgattggtgcagtgagttatgttttagaacaattagatgcaccagtatatggatctaaattgacaatagcgttaattaaagaaaatatgaaagcccgtaatattgataaaaaagttcgctactatacagttaataatgattcaattatgagattcaaaaacgtgaatattagtttctttaatacgacacacagtattcctgatagtttaggtgtttgtattcacacttcatatggtgccattgtgtatacaggtgaatttaagtttgaccaaagtttacatggacattatgcaccagatattaaacgtatggcagagattggtgaagaaggcgtatttgtcttaatcagtgattctactgaggcagagaaacctggatataatactccggaaaatgtgattgaacatcatatgtatgatgcttttgcaaaagtgcgaggtcgcttgatagtttcatgttatgcttcgaactttatacgtattcagcaagttttaaatattgctagcaagctaaatcgtaaagtgtcatttttaggaagatcacttgaaagttcatttaatattgctcgtaaaatggggtatttcgacattcctaaagatttgctaattcctataacagaagttgataattatcctaaaaatgaagtgataattatagctactggtatgcaaggagaacctgtagaagccttaagtcaaatggcgcaacataagcataaaattatgaatatcgaagaaggcgattctgtatttttagcaattacggcttctgctaatatggaagttatcattgcgaatacattaaatgagcttgtacgtgctggcgcacatattattccaaataacaaaaagattcatgcttcaagtcatggttgcatggaagaattaaaaatgatgattaatattatgaaacctgaatactttattcctgtacaaggtgaatttaaaatgcagatagcacatgcgaagctagcagctgaagcaggtgttgcaccagaaaagattttccttgtggaaaaaggagatgtcattaattacaacggtaaagatatgatattaaatgaaaaggtaaattcaggaaatattttaatagatggcattggtattggggatgtaggaaatatcgtgttgagagaccgtcatcttttagcagaagatggtatctttattgctgttgtaacgttagatcctaaaaatagacgtatagctgcgggacctgaaattcaatctcgtgggtttgtatatgtacgtgaaagtgaagacttattacgtgaagcagaagagaaagtacgtgaaatagtagaggctggtttacaagaaaaacgcatagaatggtctgaaattaaacaaaatatgcgtgatcaaattagtaaactattattcgaaagtacaaaacgtcgtcctatgattattccagtaatttctgaaatt

SEQ ID NO: 162 - protein, 574 aa, Staphylococcus aureus
MNSEFIYGRVTNLGGKILSLIKKKNKDIRIIPLGGVGEIAKNMYIVEVDDEMFMLDAGLMFPEDEMLGIDIVIPDISYVLENKDKLKGIFLTHGHEHAIGAVSYVLEQLDAPVYGSKLTIALIKENMKARNIDKKVRYYTVNNDSIMRFKNVNISFFNTTHSIPDSLGVCIHTSYGAIVYTGEFKFDQSLHGHYAPDIKRMAEIGEEGVFVLISDSTEAEKPGYNTPENVIEHHMYDAFAKVRGRLIVSCYASNFIRIQQVLNIASKLNRKVSFLGRSLESSFNIARKMGYFDIPKDLLIPITEVDNYPKNEVIIIATGMQGEPVEALSQMAQHKHKIMNIEEGDSVFLAITASANMEVIIANTLNELVRAGAHIIPNNKKIHASSHGCMEELKMMINIMKPEYFIPVQGEFKMQIAHAKLAAEAGVAPEKIFLVEKGDVINYNGKDMILNEKVNSGNILIDGIGIGDVGNIVLRDRHLLAEDGIFIAVVTLDPKNRRIAAGPEIQSRGFVYVRESEDLLREAEEKVREIVEAGLQEKRIEWSEIKQNMRDQISKLLFESTKRRPMIIPVISEI

SEQ ID NO: 163 - DNA, 1272 bp, Staphylococcus aureus
atggaaataacaatgcctaagttaggtgagagtgttcatgaaggcaccattgaacaatggttagtttctgttggtgatcatattgatgaatatgaaccattatgtgaagttattacagataaagtgacagctgaagtcccttccacgatatcaggaacaattacagaaattttagttgaagcggggcagacagtagctattgatacaattatctgtaaaattgaaactgctgatgaaaagacaaatgaaacaactgaagagatacaagcaaaagtggatgagcatactcagaaatctactaaaaaagctagtgcaacagtggaacagacatctactgctaaacaaaatcaaccacgtaataatggtcgcttttcacctgttgtatttaaactcgcttcagagcatgacattgatttatcacaagttgtaggtagtggatttgaaggtcgtgtaactaagaaggatataatgtcagttattgaaaatggtggtaccacagctcaatctgacaaacaagttcaaacaaaatcaacatcagtagatacatcaagtaaccaatcatctgaagacaatagtgaaaacagcacaataccagtaaatggtgtgcgtaaagcaattgcgcaaaatatggttaatagtgtaacagagattccacatgcatggatgatgattgaagtagatgctacaaatcttgtgaaaacgagaaatcattataaaaacagctttaaaaataaagaaggatataatctaacgttctttgctttctttgtaaaagctgtagcagatgctttaaaagcatatcctttattaaatagtagctggcaaggaaatgaaattgtcttacataaagacattaatatttcaattgctgttgctgatgaaaataaattatacgtacctgtgattaagcatgcagacgaaaagtcaatcaaaggtatagctagagaaattaatactttagcaacgaaagcgcgtaataagcaattgacagctgaagatatgcagggcggtacatttacggtaaataatactggtacatttggttcagtatcatcaatgggtattataaatcatccacaagcagcgattttacaagtagaatcaatcgttaaaaagccagtagtaattaatgatatgattgcaattcgtaacatggttaatttatgtatttcaattgatcatcgtattttagatggtttacaaacaggtaaatttatgaatcatattaaacagcgtatcgaacagtatactttagaaaatacaaatatatat

SEQ ID NO: 164 - protein, 424 aa, Artificial Sequence
  Description of Artificial Sequence:  Synthetic Peptide
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASATVEQTSTAKQNQPRNNGRFSPVVFKLASEHDIDLSQVVGSGFEGRVTKKDIMSVIENGGTTAQSDKQVQTKSTSVDTSSNQSSEDNSENSTIPVNGVRKAIAQNMVNSVTEIPHAWMMIEVDATNLVKTRNHYKNSFKNKEGYNLTFFAFFVKAVADALKAYPLLNSSWQGNEIVLHKDINISIAVADENKLYVPVIKHADEKSIKGIAREINTLATKARNKQLTAEDMQGGTFTVNNTGTFGSVSSMGIINHPQAAILQVESIVKKPVVINDMIAIRNMVNLCISIDHRILDGLQTGKFMNHIKQRIEQYTLENTNIY

SEQ ID NO: 165 - DNA, 1938 bp, Staphylococcus aureus; identical to SEQ ID NO: 1

SEQ ID NO: 166 - DNA, 939 bp, Staphylococcus aureus; identical to SEQ ID NO: 2

SEQ ID NO: 167 - DNA, 726 bp, Staphylococcus aureus
atggaggacaacatgatttatgcaggtattttagcaggaggtattggttcgagaatggggaacgtgccattaccaaaacaatttttagatattgataataaaccgattttaatccatacaattgagaagttcattttagtgagtgaatttaatgagattattatcgcaacgccagcacagtggatttcccatacacaggatattttaaaaaaatataacattacagatcaacgtgtcaaagtagttgcaggtggtacggatcgaaatgaaacaattatgaacattatcgaccatattcgcaatgtaaatggaattaataatgatgatgtgattgtaactcatgatgccgtaagaccatttttaactcaacgtattattaaagagaacattgaagtagcagcaaaatatggtgcagtagatacagtcattgaagcaattgatacgattgtaatgtctaaagataaacagaacatacacagtatccctgtaaggaatgaaatgtatcaaggccaaacaccacaatcatttaatattaaattattacaagatagttatcgcgccttaagtagtgaacaaaaagaaatcttatcagatgcatgtaaaatcattgtcgaatctggacatgcagttaaattggtacgtggagaactatacaacattaaagtgacaacaccgtatgatttaaaagtagcaaatgccattattcaaggtgatattgccgatgat

SEQ ID NO: 168 - protein, 242 aa, Staphylococcus aureus
MEDNMIYAGILAGGIGSRMGNVPLPKQFLDIDNKPILIHTIEKFILVSEFNEIIIATPAQWISHTQDILKKYNITDQRVKVVAGGTDRNETIMNIIDHIRNVNGINNDDVIVTHDAVRPFLTQRIIKENIEVAAKYGAVDTVIEAIDTIVMSKDKQNIHSIPVRNEMYQGQTPQSFNIKLLQDSYRALSSEQKEILSDACKIIVESGHAVKLVRGELYNIKVTTPYDLKVANAIIQGDIADD

SEQ ID NO: 169 - DNA, 2358 bp, Staphylococcus aureus
atgataatatattggtgtatgacagttaatggagggaacgaaatgaaagctttattacttaaaacaagtgtatggctcgttttgctttttagtgtaatgggattatggcaagtctcgaacgcggctgagcagcatacaccaatgaaagcacatgcagtaacaacgatagacaaagcaacaacagataagcaacaagtaccgccaacaaaggaagcggctcatcattctggcaaagaagcggcaaccaacgtatcagcatcagcgcagggaacagctgatgatacaaacagcaaagtaacatccaacgcaccatctaacaaaccatctacagtagtttcaacaaaagtaaacgaaacacgcgacgtagatacacaacaagcctcaacacaaaaaccaactcacacagcaacgttcaaattatcaaatgctaaaacagcatcactttcaccacgaatgtttgctgctaatgcaccacaaacaacaacacataaaatattacatacaaatgatatccatggccgactagccgaagaaaaagggcgtgtcatcggtatggctaaattaaaaacagtaaaagaacaagaaaagcctgatttaatgttagacgcaggagacgccttccaaggtttaccactttcaaaccagtctaaaggtgaagaaatggctaaagcaatgaatgcagtaggttatgatgctatggcagtcggtaaccatgaatttgactttggatacgatcagttgaaaaagttagagggtatgttagacttcccgatgctaagtactaacgtttataaagatggaaaacgcgcgtttaagccttcaacgattgtaacaaaaaatggtattcgttatggaattattggtgtaacgacaccagaaacaaagacgaaaacaagacctgaaggcattaaaggcgttgaatttagagatccattacaaagtgtgacagcggaaatgatgcgtatttataaagacgtagatacatttgttgttatatcacatttaggaattgatccttcaacacaagaaacatggcgtggtgattacttagtgaaacaattaagtcaaaatccacaattgaagaaacgtattacagttattgatggtcattcacatacagtacttcaaaatggtcaaatttataacaatgatgcattggcacaaacaggtacagcacttgcgaatatcggtaagattacatttaattatcgcaatggagaggtatcgaatattaaaccgtcattgattaatgttaaagacgttgaaaatgtaacaccgaacaaagcattagctgaacaaattaatcaagctgatcaaacatttagagcacaaactgcagaggtaattattccaaacaataccattgatttcaaaggagaaagagatgacgttagaacgcgtgaaacaaatttaggaaacgcgattgcagatgctatggaagcgtatggcgttaagaatttctctaaaaagactgactttgccgtgacaaatggtggaggtattcgtgcctctatcgcaaaaggtaaggtgacacgctatgatttaatctcagtattaccatttggaaatacgattgcgcaaattgatgtaaaaggttcagacgtctggacggctttcgaacatagtttaggcgcaccaacaacacaaaaggacggtaagacagtgttaacagcgaatggcggtttactacatatctctgattcaatccgtgtttactatgatataaataaaccgtctggcaaacgaattaatgctattcaaattttaaataaagagacaggtaagtttgaaaatattgatttaaaacgtgtatatcacgtaacgatgaatgacttcacagcatcaggtggcgacggatatagtatgttcggtggtcctagagaagaaggtatttcattagatcaagtactagcaagttatttaaaaacagctaacttagctaagtatgatacgacagaaccacaacgtatgttattaggtaaaccagcagtaagtgaacaaccagctaaaggacaacaaggtagcaaaggtagtaagtctggtaaagatacacaaccaattggtgacgacaaagtgatggatccagcgaaaaaaccagctccaggtaaagttgtattgttgctagcgcatagaggaactgttagtagcggtacagaaggttctggtcgcacaatagaaggagctactgtatcaagcaagagtgggaaacaattggctagaatgtcagtgcctaaaggtagcgcgcatgagaaacagttaccaaaaactggaactaatcaaagttcaagcccagaagcgatgtttgtattattagcaggtataggtttaatcgcgactgtacgacgtagaaaagctagc

SEQ ID NO: 170 - protein, 786 aa, Staphylococcus aureus
MIIYWCMTVNGGNEMKALLLKTSVWLVLLFSVMGLWQVSNAAEQHTPMKAHAVTTIDKATTDKQQVPPTKEAAHHSGKEAATNVSASAQGTADDTNSKVTSNAPSNKPSTVVSTKVNETRDVDTQQASTQKPTHTATFKLSNAKTASLSPRMFAANAPQTTTHKILHTNDIHGRLAEEKGRVIGMAKLKTVKEQEKPDLMLDAGDAFQGLPLSNQSKGEEMAKAMNAVGYDAMAVGNHEFDFGYDQLKKLEGMLDFPMLSTNVYKDGKRAFKPSTIVTKNGIRYGIIGVTTPETKTKTRPEGIKGVEFRDPLQSVTAEMMRIYKDVDTFVVISHLGIDPSTQETWRGDYLVKQLSQNPQLKKRITVIDGHSHTVLQNGQIYNNDALAQTGTALANIGKITFNYRNGEVSNIKPSLINVKDVENVTPNKALAEQINQADQTFRAQTAEVIIPNNTIDFKGERDDVRTRETNLGNAIADAMEAYGVKNFSKKTDFAVTNGGGIRASIAKGKVTRYDLISVLPFGNTIAQIDVKGSDVWTAFEHSLGAPTTQKDGKTVLTANGGLLHISDSIRVYYDINKPSGKRINAIQILNKETGKFENIDLKRVYHVTMNDFTASGGDGYSMFGGPREEGISLDQVLASYLKTANLAKYDTTEPQRMLLGKPAVSEQPAKGQQGSKGSKSGKDTQPIGDDKVMDPAKKPAPGKVVLLLAHRGTVSSGTEGSGRTIEGATVSSKSGKQLARMSVPKGSAHEKQLPKTGTNQSSSPEAMFVLLAGIGLIATVRRRKAS

SEQ ID NO: 171 - DNA, 567 bp, Staphylococcus aureus
atgcaagagtaccaaaaatcgttaaatacgcttaaaaagcctataaatgttccgtatgagcaagaaactgaaaaagtaggtggtttatttagcaaagaaatacaagaaactggaaatgttgtaataagccaaaaagatttcaatgaatttcagaaacagataaaagctgctcaagatatttcggaagattacgagtatataaagtctggtagagccttagatgataaagataaggaaatacgagagaaagatgatttattaaataaagcagttgagcgtattgaaaacgcagacgataattttaaccaactttacgaaaatgcaaagccacttaaagagaatatagaaatagcgttaaagcttttaaaaatcttactaaaagagttagaacgagttttaggaagaaatacctttgcggaaagagttaataagttaacagaagatgaaccaaaactaaatggtttagcaggaaacttagataaaaaaatgaatccagaattatattcagaacaggaacagcaacaagaacaacaaaagaatcaaaaacgagatagaggtatgcactta

SEQ ID NO: 172 - protein, 189 aa, Staphylococcus aureus
MQEYQKSLNTLKKPINVPYEQETEKVGGLFSKEIQETGNVVISQKDFNEFQKQIKAAQDISEDYEYIKSGRALDDKDKEIREKDDLLNKAVERIENADDNFNQLYENAKPLKENIEIALKLLKILLKELERVLGRNTFAERVNKLTEDEPKLNGLAGNLDKKMNPELYSEQEQQQEQQKNQKRDRGMHL

SEQ ID NO: 173 - DNA, 960 bp, Staphylococcus aureus
atgaagatgataaacaaattaatcgttccggtaacagctagtgctttattattaggcgcttgtggcgctagtgccacagactctaaagaaaatacattaatttcttctaaagctggagacgtaacagttgcagatacaatgaaaaaaatcggtaaagatcaaattgcaaatgcatcatttactgaaatgttaaataaaattttagctgataaatataaaaataaagttaatgataagaagattgacgaacaaattgaaaaaatgcaaaagcaatacggcggtaaagataaatttgaaaaggcccttcaacagcaaggtttaacagccgataaatataaagaaaatttacgtactgctgcttatcataaagaattactatcagataaaattaaaatctctgattctgaaattaaagaagacagcaagaaagcttcacacattttaattaaagttaaatctaagaaaagcgacaaagaaggcttagatgataaagaagcgaaacaaaaagctgaagaaattcaaaaagaagtttcaaaagatccaagtaaatttggtgaaatcgctaaaaaagaatcaatggatactggttcagctaaaaaagatggcgaattaggttatgttcttaaaggacaaactgataaagattttgaaaaagcactatttaagcttaaagatggtgaagtatcagaggttgttaaatcaagctttggatatcatattattaaagctgataaaccaacagactttaacagtgaaaaacaaagcctgaaagaaaaattagtcgatcagaaagtacaaaaaaatccaaaattattgactgatgcatacaaagatctattaaaagaatacgatgttgactttaaagatcgtgatattaaatcagttgtcgaagataaaatcttaaaccctgaaaaacttaaacaaggtggcgcacaaggcggacaatccggcatgagccaa

SEQ ID NO: 174 - protein, 320 aa, Staphylococcus aureus
MKMINKLIVPVTASALLLGACGASATDSKENTLISSKAGDVTVADTMKKIGKDQIANASFTEMLNKILADKYKNKVNDKKIDEQIEKMQKQYGGKDKFEKALQQQGLTADKYKENLRTAAYHKELLSDKIKISDSEIKEDSKKASHILIKVKSKKSDKEGLDDKEAKQKAEEIQKEVSKDPSKFGEIAKKESMDTGSAKKDGELGYVLKGQTDKDFEKALFKLKDGEVSEVVKSSFGYHIIKADKPTDFNSEKQSLKEKLVDQKVQKNPKLLTDAYKDLLKEYDVDFKDRDIKSVVEDKILNPEKLKQGGAQGGQSGMSQ

SEQ ID NO: 175 - DNA, 744 bp, Staphylococcus aureus
atgcttttagtattagctggttgctctaattctaacgataataatgaaagtaaaaaagatgacgcagacaatggtaagaaacaagagattcaagttgcagcggcagcaagtttaacagatgtaaccaagaaattagcttcagaatttaaaaaagagcataaaaatgctgatattaaatttaactatggtggatcaggggcattaagaaaacaaattgaatcaggcgcacctgttgacgtatttatgtctgcaaatactaaagatgtagatgcattaaaagacaagaataaagcgcatgatacatataaatatgcgaaaaatagtctagtattaattggtgataaagattcaaattacacttcagtaaaagacttaaaagacaatgataaattagcattaggtgaagtgaaaactgtaccagcaggaaaatatgcgaaacagtatttagataacaataacttatttaaagaagtcgaaagtaaaatcgtttatgctaaagatgtaaaacaagtattaaattatgttgaaaagggtaatgcgaaacaaggttttgtgtataaaactgacttatataaacaaaataaaaaaattgatactgtaaaagtaattaaagaagtagaacttaagaagccaatcacatacgaagctggtgctacatcagatagtaaattagcaaaagagtggatggaattcttaaaatcagataaagctaaagaaatactaaaagaataccactttgcagca

SEQ ID NO: 176 - protein, 248 aa, Staphylococcus aureus
MLLVLAGCSNSNDNNESKKDDADNGKKQEIQVAAAASLTDVTKKLASEFKKEHKNADIKFNYGGSGALRKQIESGAPVDVFMSANTKDVDALKDKNKAHDTYKYAKNSLVLIGDKDSNYTSVKDLKDNDKLALGEVKTVPAGKYAKQYLDNNNLFKEVESKIVYAKDVKQVLNYVEKGNAKQGFVYKTDLYKQNKKIDTVKVIKEVELKKPITYEAGATSDSKLAKEWMEFLKSDKAKEILKEYHFAA

SEQ ID NO: 177 - DNA, 738 bp, Staphylococcus aureus
ttggcatacacatacactttaaaagatattattgaaattacaggtgtaactaaaagaactttacattattacgatgaaataggattattagttccagataaaaatgataaaaattatcgcgtttataaacagcaagacttagaaaaattacaaaagattttaatactcaagtcttttgattttgatatcgctaaaataaaacaatacatttcgtatgataatgaacaattgcgaaagttattatcagagcaaataagcaagttagataaaaagatttctgacttacaattaattagacgctctgtatgtgaatttattaaaggactctctctaatagataccagcattttaaacaagacactacagtcacaatatgataaagaagcatctataaaatatggtcatacgaaagcatatcaatcatttattagacgtaaagacagcttacaatcgcaggatatcagacataaattgacaactatcttcaataaatttaatcatatgtctttgagtcattatccaatccaagattgtagtgatctcgtatttgagtggaaggcatttatgaacactatcgctgattttgatgatgaaacattatgctgtattgctaaaacatatgaagatgatacgcgtttcaaagattactttaattcatatgataatcaaaatttagcatcatacatttcagaagctgttaattattttttgagcaatgtgaataagagcgacaatttt

SEQ ID NO: 178 - protein, 246 aa, Staphylococcus aureus
MAYTYTLKDIIEITGVTKRTLHYYDEIGLLVPDKNDKNYRVYKQQDLEKLQKILILKSFDFDIAKIKQYISYDNEQLRKLLSEQISKLDKKISDLQLIRRSVCEFIKGLSLIDTSILNKTLQSQYDKEASIKYGHTKAYQSFIRRKDSLQSQDIRHKLTTIFNKFNHMSLSHYPIQDCSDLVFEWKAFMNTIADFDDETLCCIAKTYEDDTRFKDYFNSYDNQNLASYISEAVNYFLSNVNKSDNF

SEQ ID NO: 179 - DNA, 1737 bp, Staphylococcus aureus
atggcaaaaataaaagcaaatgaagcattagttaaagcattacaagcatgggatatagatcacttgtatggtattccaggagactcaatcgacgcagtagtcgatagtttacgtacagtgagagatcaatttaaattttatcatgtacgtcatgaagaagtagcaagcttagcggctgctggttacacaaaattaactggtaaaatcggtgtggcattaagtatcggtggccctggtttaattcatttattaaatggtatgtatgatgccaaaatggataatgtaccgcaattaatattatctggacaaacgaatagtacagcacttggaacgaaagcattccaagaaacaaatttacaaaaattatgtgaagatgtagccgtttataatcaccaaattgaaaaaggtgacaatgtgtttgaaatcgttaacgaagcaattcgtacggcatatgaacaaaaaggtgtagctgttgttatttgtcctaacgacttattaactgaaaaaattaaagatacaacgaataaaccagtagatacatcaagaccaacagtagtatcaccaaaatataaagacatcaaaaaagcggttaaactaattaataaaagtaaaaagcctgtcatgttaattggtgtaggtgcgaaacatgcgaaagatgagctacgtgaatttattgaaatggctaaaattcctgtcattcattcattaccagctaaaacaatcttgccggatgatcatccatatagtatcggtaacttaggtaaaatcggtaccaaaacatcttatcaaacaatgcaggaagcggatttattaattatggttggtacaaactatccatatgtggattacttacctaagaaaaatattaaagccattcaaattgacacaaatcctaaaaatatcggacatcgtttcaatattaatgtaggaattgttggagatagtaaaattgcgttgcatcagttaactgaaaatattaaacatgttgctgaaagaccattcttaaacaaaacgttagaacgtaaagcggtttgggataaatggatggaacaagataaaaataataatagtaaaccattacgtccagaacgattaatggcatcaatcaataaatttattaaagatgatgcagtgatttcagcagatgtaggtacagcaacagtttggtcaactcgatacttaaaccttggtgtaaataacaagttcatcatttcaagttggttaggtacaatgggttgcggtcttccaggtgcaattgcatcaaaaattgcatatccaaatagacaagccatcgcaattgctggtgacggtgcattccaaatggtaatgcaagacttcgctacagcagtacaatatgatttacctttaactgtatttgtacttaataacaaacagttagcatttattaaatatgaacaacaagcagctggtgaattagaatatgcagttgatttttctgatatggatcatgcaaaatttgctgaggcagcaggtggtaaaggttatacaattaagagtgctagcgaagtagatgctatagtcgaagaggcattagcacaagatgtaccaacgattgtagatgtatatgttgatcctaatgctgcgccattaccaggtaaaattgtaaatgaagaagcgcttggttatggtaagtgggcatttagatcaattactgaagataaacatttagatttagatcaaattccaccaatttcagtggcagcaaaacgtttctta

SEQ ID NO: 180 - protein, 579 aa, Staphylococcus aureus
MAKIKANEALVKALQAWDIDHLYGIPGDSIDAVVDSLRTVRDQFKFYHVRHEEVASLAAAGYTKLTGKIGVALSIGGPGLIHLLNGMYDAKMDNVPQLILSGQTNSTALGTKAFQETNLQKLCEDVAVYNHQIEKGDNVFEIVNEAIRTAYEQKGVAVVICPNDLLTEKIKDTTNKPVDTSRPTVVSPKYKDIKKAVKLINKSKKPVMLIGVGAKHAKDELREFIEMAKIPVIHSLPAKTILPDDHPYSIGNLGKIGTKTSYQTMQEADLLIMVGTNYPYVDYLPKKNIKAIQIDTNPKNIGHRFNINVGIVGDSKIALHQLTENIKHVAERPFLNKTLERKAVWDKWMEQDKNNNSKPLRPERLMASINKFIKDDAVISADVGTATVWSTRYLNLGVNNKFIISSWLGTMGCGLPGAIASKIAYPNRQAIAIAGDGAFQMVMQDFATAVQYDLPLTVFVLNNKQLAFIKYEQQAAGELEYAVDFSDMDHAKFAEAAGGKGYTIKSASEVDAIVEEALAQDVPTIVDVYVDPNAAPLPGKIVNEEALGYGKWAFRSITEDKHLDLDQIPPISVAAKRFL

SEQ ID NO: 181 - DNA, 26 bp, Staphylococcus aureus
gtagtagtttagggcttgcaacgcac

SEQ ID NO: 182 - DNA, 28 bp, Staphylococcus aureus
caccatcatagaacatacaattgctagc

SEQ ID NO: 183 - DNA, 22 bp, Staphylococcus aureus
ctgatactggacaacatagaga

SEQ ID NO: 184 - DNA, 24 bp, Staphylococcus aureus
aagtaacgttatctttcgaatggt

SEQ ID NO: 185 - DNA, 27 bp, Staphylococcus aureus
atttctggcactcaagtatatcaagac

SEQ ID NO: 186 - DNA, 22 bp, Staphylococcus aureus
tggcttaggtgttggtgtaggc

SEQ ID NO: 187 - DNA, 22 bp, Staphylococcus aureus
ataatgcaactacaactcagcc

SEQ ID NO: 188 - DNA, 27 bp, Staphylococcus aureus
ttgatcgttgatgtattttgattagat

SEQ ID NO: 189 - DNA, 23 bp, Staphylococcus aureus
ctacaataactacagccgttaca

SEQ ID NO: 190 - DNA, 23 bp, Staphylococcus aureus
gtgaatgaagttataaccagcag

SEQ ID NO: 191 - DNA, 23 bp, Staphylococcus aureus
cacgctaaagcatcagtgacaga

SEQ ID NO: 192 - DNA, 27 bp, Staphylococcus aureus
agcattttgatgtgttgctgttgtgtt

SEQ ID NO: 193 - DNA, 20 bp, Staphylococcus aureus
gaatccccaagcacctaaac

SEQ ID NO: 194 - DNA, 22 bp, Staphylococcus aureus
gtaaacgttgatcaagcacact

SEQ ID NO: 195 - DNA, 28 bp, Staphylococcus aureus
tttgcaataacagcaacatctggtgcag

SEQ ID NO: 196 - DNA, 27 bp, Staphylococcus aureus
gaaacttctgaagctggaattgtacgg

SEQ ID NO: 197 - DNA, 1755 bp, Staphylococcus aureus
atgagaaaaactaaaattgtatgtacaattggaccagcttcagaatcagaagaaatgattgagaaattaatcaatgctggtatgaacgttgcacgattaaacttttcacatggtagtcatgaagagcataaaggtagaattgatacaattcgtaaagtagctaaaagattagacaaaattgtagcaattttattagatacaaaaggtccagaaattcgtacgcataatatgaaagacggtatcattgaacttgaacgtggcaacgaagttattgttagcatgaatgaagttgaaggaacacctgaaaagttctcagtaacatatgaaaacttaattaacgatgttcaagtaggttcatacattttacttgatgatggcttaattgaattacaagttaaagatattgaccatgctaaaaaagaagttaaatgtgatattttaaactctggtgagcttaaaaacaaaaaaggtgttaacttacctggcgtaagagtaagtttacctggtattacagaaaaagatgctgaagatatccgtttcggtattaaagaaaatgttgacttcattgcagcaagtttcgtacgtcgtcctagtgatgttttagaaattcgtgaaattttagaagaacaaaaagctaacatttcagtattccctaaaattgaaaaccaagaaggtattgataatattgcggaaattcttgaagtgtctgatggtttaatggttgcacgtggtgacatgggtgttgaaattccacctgaaaaagtaccaatggttcaaaaagatttaatcagacaatgtaacaaattaggtaaaccagttattacagctacacaaatgttagattctatgcaacgtaacccacgtgctacacgtgcagaagctagtgacgttgccaacgcaatctatgatggtacagatgcagtaatgttatctggtgaaactgctgctggtttatatcctgaagaagctgttaaaacaatgagaaatattgctgtatcagctgaagcagcccaagattacaaaaagttattgtcagatcgtactaaattagttgaaacttcattagtgaatgctatcggtatttcggttgcacatacagctttaaacttaaatgttaaagcaattgtagctgctactgaaagtggttcaacggcacgtactatctccaaatatcgtccacattcagacattattgcggtgactccaagtgaagaaactgcacgtcaatgttcaattgtttggggagttcaacctgtagttaaaaaaggacgtaagagtacagatgcattgttaaacaatgcagttgcaacagctgttgaaactggtagagtatctaatggtgatttaatcattattactgctggtgtaccaactggtgaaactggaactactaatatgatgaaaatccacctagttggtgacgaaattgctaatggtcaaggtattggacgtggatcagttgttggtactacgttagttgctgaaactgttaaagatttagaaggtaaagatttatctgacaaagttatcgttactaactcaatcgatgaaacgtttgtaccttatgtagaaaaagctttaggcttaattacagaagaaaatggtattacatcaccaagtgcaattgttggtttagaaaaaggtattccaacagttgtaggtgtagaaaaagctgttaaaaacataagcaataacatgttagttacgattgatgctgctcaaggtaaaatctttgaaggatatgcaaacgtacta

SEQ ID NO: 198 - DNA, 1179 bp, Staphylococcus aureus
atgcaattcgataatattgacagtgctttaatggctttaaaaaatggagaaccaattattgtagtagatgatgagaatcgtgaaaatgaaggtgatttagtagcggttactgaatggatgaacgataataccattaattttatggcgaaagaagcaaggggattaatatgcgcaccagtgtctaaagatattgcacaacgtttggatttggtacaaatggttgatgataactccgacatctttggtacgcaatttacagtgagtattgatcatgtagatacaacaacaggaattagtgcttatgaacgtacattgactgccaaaaagctcattgatcctagtagtgaagctaaagattttaatcgtcctggtcatttatttccattagtagcacaagataaaggcgtattagctagaaatggacacacagaagcggctgttgatttagctaaacttactggtgccaagcccgctggtgtcatttgtgagattatgaatgatgacggcacgatggcgaaaggacaagatttacaaaagtttaaagaaaaacatcaattaaagatgattacgattgatgatttaattgaatatcgtaaaaaattagaaccagaaattgaatttaaggcaaaagtgaaaatgcctacagatttcggaacatttgatatgtatggttttaaagcgacatacacagatgaagagatagttgtactgacaaaaggtgcaattcgacaacatgaaaatgtacgcttacattctgcgtgccttacaggcgatattttccatagtcaacgttgtgattgtggtgctcaacttgaatcgtctatgaagtatatcaatgaacatggtggcatgattatttatctacctcaagaaggtcgtggcataggattgttaaacaaattacgcgcatatgaattaattgagcaaggatatgatacagtaactgcaaatttagcattaggttttgatgaagatttgcgagattatcatattgctgcacagattttaaaatattttaacatcgaacatatcaatttattaagtaataatccaagtaaatttgagggattaaaacaatatggcattgatattgcagaaagaattgaagttatcgtaccagaaacggtacataatcatgattatatggaaacgaaaaaaataaaaatgggtcatttaata

SEQ ID NO: 199 - DNA, 981 bp, Staphylococcus aureus
atgaaaatgaaaaaattagtcaaatcatcagttgcttcatcaattgcactgcttttgctatcgaatacagttgatgcagctcaacatatcacacctgtaagcgagaaaaaagtagatgacaaaatcactttatacaaaacaacagcaacatctgataatgataaattgaatatttctcaaattttaacgtttaatttcattaaggataaaagttatgacaaagatacgttagtacttaaggcagccggaaacattaattcaggttataaaaagcctaatccaaaagattacaattactcacagttttattggggcggtaagtataatgtttcggttagttcagaatcaaatgatgctgtaaatgttgttgactatgcacctaaaaatcaaaatgaagaattccaagttcaacaaacattaggttattcttatggcggagatattaatatatctaatggcttatcaggtggattaaatggatcaaaatcattttcagaaacgataaattataaacaagaaagttacagaactacgattgatagaaaaacaaatcataaatcaattggctggggtgttgaggcgcacaaaattatgaataatggttggggaccatatggtagagatagttatgacccaacatatggtaatgaactgtttttaggcggtagacaaagtagttcaaatgctggtcaaaatttcttgccaacacatcaaatgcctttattggcgcgtggtaactttaacccagaatttataagcgtactttctcataaacaaaatgatacaaaaaaatctaaaatcaaagtaacttaccaaagagaaatggatagatatactaatcaatggaatcgactacactgggttggtaataactacaaaaatcaaaatacagtaacgtttacatctacttatgaagttgactggcaaaaccatactgttaaattaatcggtacggattctaaagaaactaatcctggagta

SEQ ID NO: 200 - DNA, 870 bp, Staphylococcus aureus
atgaagaaaaaagcgttactaccattatttttaggtattatggtctttttggctggttgtgactattctaaacctgaaaaacgtagtgggtttttctacaatacattcgtagatccaatgaaaaatgtattggattggttgggaaataacttattaaacgacaattatggtttagctattattatccttgtattggtaattcgtattattttattaccattcatgttgtcaaactataaaaatagtcatatgatgcgtcaaaaaatgaaagttgcaaagccagaagttgaaaaaattcaagaaaaagtgaaacgtgcgcgtacacaagaagaaaaaatggctgcaaaccaagaattaatgcaagtatataaaaagtatgacatgaacccgattaagagtatgttgggttgtttaccaatgctaatccaattaccaatcatcatgggattatactttgtacttaaagaccaacttgtagatggtttgtttaaatatccacacttcttatggttcgatttaggacgtcctgatatttggattacaattattgccggtgttttatactttatccaagcatatgtatcaagtaaaacgatgccagacgaacaacgtcaaatgggttacatgatgatggtcatttcaccaattatgattatctggatttcattaagctcagcatcagcacttggtttgtactggtcagtcagtgcggcgttccttgtagttcaaacacactttgcgaacatttattatgaaaaagtcgctaaaaaagaagtacaacctttcattgaagcgtatgaaagagagcacaacggcggcagcaataaaaaaggcaaaaacacacaagttgtgtctaaaaagaaaaagaaa

SEQ ID NO: 201 - DNA, 7434 bp, Staphylococcus aureus
atgaatttattcagacaacaaaaatttagtatcagaaaatttaatgtcggtattttttcagctttaattgccactgttacttttatatctactaacccgacaacagcgtctgcagcagagcaaaatcagcctgcacaaaatcaaccagcacaaccagctgatgccaatacacagcctaacgcaaatgctggtgctcaagctaatcctacagcacagccagctgcacctgccaaccaaggacaaccagcagtacaaccagcaaaccaaggtggacaggctaatccagcaggaggagcagcacaaccaaatacacaaccagctggacaaggtaatcaagctgatccgaataacgctgcacaagcacaacctggaaatcaagcaacaccggcaaaccaagcaggtcaaggaaataaccaagcaacacctaataataatgcaacaccggcaaatcaaacacagccagcgaatgctccagcagcagcgcaaccagcagcacctgtagcagcaaacgcacaaactcaagatccaaatgctagcaatactggtgaaggcagtattaatacgacattaacatttgatgatcctgccatatcaacagatgagaatagacaggatccaactgtaactgttacagataaagtaaatggttattcattaattaacaacggtaagattggtttcgttaactcagaattaagacgaagcgatatgtttgataagaataaccctcaaaactatcaagctaaaggaaacgtggctgcattaggtcgtgtgaatgcaaatgattctacagatcatggtaactttaacggtatttcaaaaactgtaaatgtaaaaccagattcagaattaattattaactttactactatgcaaacgaatagtaagcaaggtgcaacaaatttagttattaaagatgctaagaaaaatactgaattagcaactgtaaatgttgctaagactggtactgcacatttatttaaagtaccaactgatgctgatcgtttagatttacaatttattcctgacaatacagcagttgctgatgcttcaagaattacaacaaataaagatggttataaatactattcattcattgataatgtaggtctattctcaggatcacatttatatgtcaaaaatagagatttagcaccgaaagcaactaacaataaagaatatactattaatactgaaatcggtaacaatggtaattttggtgcttcattaaaagcagatcaatttaaatatgaagtaacattaccacaaggtgtaacttacgttaataattcattaactacaacattccctaatggtaatgaagacagtacagtattgaaaaatatgactgttaattatgatcaaaatgcaaataaagttacatttacaagccaaggtgtgacaacggcacgtggtacacacactaaagaagttttattcccagataaatctttaaaattatcatataaagttaatgttgcgaatatcgatacacctaaaaatattgattttaatgaaaaattaacatatcgtactgcttcagatgttgtaattaataatgcgcaaccagaagttacactaactgcagatccattttcagtagcggttgaaatgaacaaagatgcgttgcaacaacaagtaaactcacaagttgataatagtcattacacaacagcatcaattgcagaatacaataaacttaaacaacaagcagatactattttaaatgaagatgcgaatcatgttaaaactgcaaatcgtgcatctcaagcggatattgatggtttagtaactaaattacaagctgcattaattgataatcaagcagcaattgctgaattagatactaaagctcaagaaaaggttacagcagcacaacaaagtaaaaaagttacgcaagatgaagttgcagcacttgtaactaaaattaacaatgataaaaataatgcaatcgcagaaattaataaacaaactacagcacaaggtgtcacaactgaaaaagataatggtatcgcagtgttagaacaagatgtgattacaccaacagttaaacctcaagcgaaacaagatattatccaagcagttacaactcgtaaacaacaaattaaaaagtcaaatgcatcattacaagatgaaaaagatgtagcaaatgataaaattggtaaaattgaaacaaaggcaattaaagatattgatgcagcaacaacaaatgcacaagtagaagccattaaaacaaaagcaatcaatgatattaatcaaactacacctgctacaacagctaaagcagcagctcttgaagaatttgacgaagttgttcaagcacaaattgatcaagcacctttaaatcctgatacaacaaatgaagaagtagcggaagctattgaacgtattaatgcagctaaagtttctggtgttaaagcaattgaagcgacaacgactgcacaagatttagaaagagttaaaaacgaagaaatctcaaaaattgaaaatattactgactctacgcaaacaaaaatggatgcctataatgaagttaaacaagctgcaacagctagaaaagctcaaaatgctacagtttcaaatgcaacaaatgaagaagtagcagaagctgatgcagcagtagatgcagctcaaaagcaaggtttacatgacatccaagttgttaaatcaaaacaggaagttgctgatacaaaatcaaaagtattagataaaatcaatgcaattcaaacacaagcaaaagttaaacctgcagctgatacggaagtagaaaacgcatataatacacgtaaacaagaaattcaaaatagcaatgcttcaactacagaagaaaaacaagctgcatatacagaattagatactaaaaagcaagaagcaagaacaaatcttgatgctgcaaatacaaacagtgatgtaacaacagctaaagacaatagtattgctgcaattaatcaagttcaagctgccacaactaagaaatcggatgcaaaagcggaaatcgctcaaaaagcaagtgaacgtaaaacagcaattgaagcaatgaatgattcgactactgaagaacaacaagcagcgaaagacaaagtggatcaagcagtagttactgcaaacgctgatatagataatgctgcagcaaacaatgatgtggataatgcaaaaactacaaatgaagctacaatcgcagccattacacctgatgcaaatgttaaaccagcagcaaaacaagcaattgcagataaagtacaagctcaagaaacagcaattgatggaaataacggctcaacaactgaagaaaaagcagctgctaaacaacaagttcaaactgaaaaaacaacagctgatgccgcaatagatgcagcacatacaaatgcggaagttgaagcggctaaaaaagcagcaattgctaaaattgaagcgattcagccagcaacaacaactaaagataatgcgaaagaagcaattgctacgaaagcgaatgaacgtaaaacagcaatcgctcaaacgcaagacattactgctgaagaaattgcagcggctaatgcggacgtagataatgctgtgacacaagcaaatagcaacattgaagctgctaatagtcaaaatgatgtagaccaagcgaaaacgacaggtgaaaatagtattgatcaagtaacaccaacagttaataaaaaagcaactgcacgtaatgaaatcacagcaattttaaataacaaattgcaagagattcaagctacgccagatgcaacagatgaagaaaaacaagcagctgatgctgaagcaaatactgaaaatggtaaagcaaatcaagccatttcagcagcaactactaacgcacaagttgatgaagctaaagcaaatgcagaagcagcgattaatgcggtaacaccaaaagttgtgaagaaacaagcggctaaagatgaaattgatcaattacaagcaacgcaaacaaatgttatcaataatgatcagaacgctacaacagaagaaaaagaagcagctattcaacaattagcaacagcagttacagacgcgaaaaataatattacagctgcaactgatgataatggtgtagatcaggcgaaagacgctggaaagaattcaattcaaagcacgcaaccagcaacagcggttaaatcaaatgctaaaaatgatgttgatcaagctgtgacaactcaaaatcaagcaattgataatacaactggtgctacaactgaagagaaaaatgcagcaaaagatttagttttaaaagctaaagaaaaagcgtatcaagatatcttaaatgcacaaacaactaatgatgttacgcaaattaaagatcaagcagttgctgatattcaaggtattactgcagatacaacaattaaagatgttgcgaaagatgaattagcaacaaaagcaaacgaacaaaaagcgcttattgcacaaactgcagatgcgactactgaagaaaaagaacaagcaaatcaacaagtagacgcacaattaacacaaggtaatcaaaatattgaaaatgcacagtcaatcgatgatgtaaacactgcaaaagataatgcaattcaagcaattgacccaattcaagcatcaacagatgttaaaacgaatgcaagagcggaattgctaactgaaatgcaaaataaaataactgaaatacttaataataatgagactactaatgaagaaaaaggtaacgatattggaccagttagagcagcatatgaagaaggtttaaataatattaatgcagcaactactacaggtgatgtaactactgctaaagatacagcagtacaaaaagttcaacaacttcatgcaaatcctgttaagaaaccagcaggtaaaaaagaattagatcaagctgcagctgataagaaaacacaaatagaacaaacaccaaatgcatcacaacaagaaattaatgatgcaaaacaagaagttgatactgaattaaatcaagcgaaaacaaatgtcgatcaatcatcaacaaatgaatatgttgataatgcagttaaagaaggaaaagctaaaattaatgcagttaaaacatttagtgagtacaaaaaagatgctttagctaaaattgaagatgcatataatgctaaagtaaacgaagcggataactctaacgcatcgacttcaagtgaaattgctgaagcgaaacaaaaacttgctgaattaaaacaaactgcggatcaaaatgttaatcaagctacttctaaagatgacattgaagttcaaattcataatgacttagataatattaacgattacacaattccaacaggtaaaaaagaatcagctacaacagatttatatgcttatgcagatcagaagaaaaataatatttcagctgacactaatgcaacacaagatgaaaagcaacaagcaattaagcaagttgaccaaaatgttcaaactgcattagaaagcattaataatggtgtggataatggtgacgttgatgatgcattaacacaaggtaaagcagcaattgatgctattcaagtagatgctactgttaaacctaaagcgaaccaagctattgaagttaaagcagaagatacgaaagaatctattgatcaaagtgaccagttaactgctgaagaaaaaactgaagcattagcaatgattaaacaaattacagatcaagctaaacaaggtattactgatgcaacaacaactgctgaagttgaaaaagcgaaagctcaaggacttgaagcatttgataacattcaaatcgactcaacagaaaaacaaaaagctatcgaagaattagaaactgcactagaccagattgaagcaggtgtaaatgtcaacgctgatgctacaactgaagaaaaagaagcgtttacgaatgctttagaagacattttatcaaaagcaactgaagatatttctgatcaaactacaaatgcagaaatcgctactgtcaaaaatagtgcgcttgaacaacttaaagcacaacgtattaatcctgaagttaagaaaaatgctttggaagcaatcagagaagtggttaacaagcaaatagaaataattaaaaatgcagatgcagatgcatcggcgaaagaaattgcacgtacggatttaggtagatattttgacagatttgctgataaattagataaaacacaaacaaatgcagaagttgctgaattacaaaatgtaacgatacctgcaattgaagcgattgtgcctcagaatgatccagatgctaatgatactaataatggtatagataataatgatgcaacagcaaattcaaatgctaatgcaacaccagaaaatactggacaacctaacgtatctgagacgacagctaatggcaaagcagacgcttctccgacaacaccaaataatagtgatgcggcaacaggtgaaacaacagcaacatcagcaactgatgatgcaaatgataaaccgcaagctaataacaattctagtgtagatgcatcaacaaacagtccgacaatggataacgatgtaactagtaaaccagaagtagaatcaactaataacggcacaactgataaacctgtaacagaaactgataatgcaacgccagcagaaagcacaacaaataacaatagtacaactacagcaacaaacgagaatgcaccaacaggatcaacagcaacggctccaacaactgcgagcacagaagcagcatcatctgctgatagcaaagataatgcatctgtaaatgattcaaaacaaaatgctgaagtaaataatagtgctgaatctcaatcaactaatgacaaggttgcacaaccaaaatctgaaaataaagctaaggcagaaaaagatggtagtgattcaacaaatcaaagtatggttgaatcaacaactgaaacattgccttcagcagacataacagaaccaaatgtaccttctaatacatcaaaagataaagaagaaagtacgacaaatcaaactgatgcaggacaacttaagtctgaaactaacgttgcatctaacgaagcagataaatcgccaagcaaagctgatactgaagtttcgaataaaccatcaacatctgcatcttctgaagcaaaagaaaaaatgacttcaactaatcttagccaaaaagatgatacggcaacagcagatactaatgatacgcaaaaatcagttggttcagctgcaaacaataaagctacgcaaaacgacggtgccaatgcatctccagctacagtttcaaatggaagcaatagtgctaatcaagatatgcttaatgtaactaacactgacgaccaccaagctaagacaaaatcagctcaacaaggaaaagttaataaagctaaacaacaagctaaaactttaccagatactggtatgtcacataatgacgatttaccatatgctgaattagctctaggtgcaggtatggcattcttaattagaagattcactaagaaagaccaacaaactgaagaa

SEQ ID NO: 202 - DNA, 423 bp, Staphylococcus aureus
atgaaactaaaatcatttgttactgccactttagcattgggattattatcaacggtcggagctgcattaccgagtcacgaagcatctgcagatagtaataacggctataaagaaatgactgtggatggttatcacactgttccttacacaatttcagtagatggtattactgcattacatcgaacttactttatcttcccagaaaataaaaatgttctttatcaagaaattgacagtaaagtaaaaaatgaattagcttctcaacgtggtgttacaacagaaaaaattaataatgcccaaacagcaacttatacgcttactttgaatgatggtaataaaaaagtagtgaatctaaagaaaaatgacgacgctaaaaattcaattgatccaagtacaatcaaacagatacaaattgtagttaaa

SEQ ID NO: 203 - DNA, 831 bp, Staphylococcus aureus
atggctattaaaaagtataagccaataacaaatggtcgtcgtaatatgacttcgttagatttcgcagaaatcacgaaaactacacctgaaaagtcattattaaaaccgctaccgaaaaaagcgggacgtaacaaccaaggtaaattgactgtaagacaccatggtggtggacacaaacgtcaataccgtgttatcgatttcaaacgtaacaaagatggtatcaatgcaaaagttgattctattcaatatgatccaaaccgctcagcaaacatcgctttagttgtatatgcagacggtgaaaaacgatatatcattgctcctaaaggattagaagtaggtcaaatcgttgaaagtggtgctgaagctgacatcaaagttggtaacgcattaccattacaaaacattccagttggtacagtagtacacaacatcgagcttaaacctggtaaaggtggacaaatcgctcgttcagctggtgcaagtgctcaagtacttggtaaagaaggtaaatacgtattaatcagattaagatctggtgaagttcgtatgatcttatctacttgccgtgctacaatcggtcaagttggtaacctacaacacgaattagttaacgttggtaaagccggacgttcaagatggaaaggtatccgtccaacagttcgtggttctgtaatgaaccctaacgatcacccacacggtggtggtgaaggtcgtgctcctatcggtagaccatctccaatgtcaccatggggtaaacctacgcttggtaagaaaactcgtcgtggtaaaaaatcatcagacaaacttatcgttcgtggacgtaagaaaaaa

SEQ ID NO: 204 - DNA, 1596 bp, Staphylococcus aureus
atgttagtaaatacgtttaacccatttgataatttattattatcgtctttaattgcagcaataccgattgtactgtttttactatgtttaactgtttttaaaatgaaaggtatttatgcagctattacaacacttgttgtaacattactaattgcaataccatttttcaaattgccagttggtatcgcttctggtgcagtagtcgaaggtttcttccaaggtatcattccgattggctatatcgttatgatggcagtattgttatacaaaattactgttgaatctggacaatttttaacaattcaagatagtattacaaatatttcacaagaccaacgtattcaagttttacttattggatttgcattcaacgcatttttagaaggtgcagcaggatttggtgtaccaattgcaatttgtgcacttttattaacacaattaggatttaatccattaaaagctgcgatgttatgtttagtcgcaaatgcagcgtctggtgcttttggtgcgattggtatccctgtaggtgttgtagaaacgttgaaattacctggagatgtttcagtattaggtgtttctcaatcagcaactttaacattggcaatcataaatttcattattccattcttacttatctttattattgatggttttagaggtgttaaagaaacattaccagcaattttagtagtttcaatcacttatacacttactcaaggattattaactgtattcagtggacctgaattagcagatattattccaccgttattaacaatgttagcattagcagtattttctaaaaaattccaaccaaaacacatttatcgtgttaataaagatgaagaaattgaacctgcaaaagcacattctgcaaaagcagtattacatgcatggagcccattcattgtattaacagtcattgtaatgatttggagtgcgccattctttaaaaacttattcttaccaaatggtgctttatcatcattagtatttaaattcaacttacctggaacaatcagcgaagttacgcataaaccattagtattgactttaaatattattggacaaacaggtacagctattttattaactattattattacaattttaatgtctaaaaaggttaactttaaagatgcaggtagattattcggcgttacatttaaagagttgtggttaccagttcttacaatttgtttcatcttagcaatttctaaaatcacaacttatggtggtttaagtgcagcaatgggtcaaggtattgctaaagcaggtaatgtcttcccagttctatcaccaattttaggttggataggtgtgtttatgacaggatcagttgtaaataacaactcattatttgcaccaattcaagcttctgttgcacaacaaattggaacaagtggttcacttcttgtatctgctaatacagttggtggtgtagcggcaaaattgatttcaccacaatcaattgcaattgcaactgcagcagtaaaacaagttggtaaggaatcagaattattaaaaatgacattgaaatacagtgtatgtttactaatattcatctgtatttggactttcatcttgtcattatta

SEQ ID NO: 205 - DNA, 945 bp, Staphylococcus aureus
atgcttaaaaataaaatattaactacaactttatctgtgagcttacttgcccctcttgccaatccgttattagaaaatgctaaagctgctaacgatactgaagacatcggtaaaggaagcgatatagaaattatcaaaaggacagaagataaaacaagtaataaatggggcgtgactcaaaatattcaatttgattttgtaaaggataaaaaatataacaaagatgctttgatattaaagatgcaaggattcattagctctagaacaacatattacaactataaaaaaactaatcatgttaaagctatgcgatggccattccaatataatattggtttaaaaacaaatgataaatatgtttctttaattaattatttacctaaaaataaaattgaatctacaaacgtgagtcagatattaggatacaatatcggtggtaatttccaatcagccccatcactcggtggtaatggatcatttaactattctaaatcgattagctatacacaacaaaattatgtaagtgaagtagaacaacaaaactcaaaaagtgttttatggggcgtcaaagcgaattcattcgccactgaatcaggtcaaaaatcagcctttgatagcgatttatttgtaggctacaaacctcatagtaaagatcctagagattatttcgttccagacagtgagttaccacctcttgtacaaagtggatttaacccttcatttatcgccacagtatctcatgaaaaaggttcaagcgatacaagcgaatttgaaattacttacggaagaaacatggatgtcactcatgccattaaaagatcaacgcattatggcaacagttatttagacggacatagagtccataatgcatttgtaaatagaaactatactgtgaaatacgaggtcaattggaagactcatgaaatcaaggtgaaaggacagaat

SEQ ID NO: 206 - DNA, 975 bp, Staphylococcus aureus
atgaaaatgaataaattagtcaaatcatccgttgctacatctatggcattattattactttctggtactgctaatgctgaaggtaaaataacaccagtcagcgtaaaaaaagtcgatgacaaagttactttatacaaaacaacagccacagcagattctgataaatttaaaatttcacagattttaacatttaatttcatcaaagataaaagttatgataaagatactttagtacttaaagctactgggaatattaactcaggctttgtgaaacctaatcctaatgactatgacttttcaaaattatattggggagctaaatacaatgtatctataagctcacaatctaatgattcagtaaacgtcgttgattatgcaccaaaaaatcaaaatgaagagtttcaagttcaaaatactttaggctatacatttggtggtgacattagtatctctaatggtttatctggtggacttaatggaaatacagctttttctgaaacaattaattataaacaagaaagttacagaacaacattaagtcgcaacacaaattataaaaatgttggctggggagttgaagcacataaaattatgaataatggttggggaccttatggaagagatagcttccacccaacatatggtaatgaactcttcttagctggcagacaaagcagtgcatacgctggccaaaacttcatagcgcaacaccaaatgccattattatctagaagtaacttcaatccagaatttttaagcgtactatcacacagacaagatggcgctaaaaaatctaaaattacagtaacttatcaacgtgaaatggatttataccaaattcgttggaatggcttctactgggcaggcgcaaattataaaaactttaaaactagaacatttaaatcaacatatgaaattgattgggaaaatcacaaagtgaaattgttagatacaaaagaaactgaaaacaataaa

SEQ ID NO: 207 - DNA, 1008 bp, Staphylococcus aureus
atgaatagagagatgttgtatttaaatagatcagatattgaacaagcgggaggtaatcattcacaagtttatgtggacgcattaacagaagcattaacagcccatgcgcacaatgattttgtacaaccgcttaagccgtatttaagacaggatcctgaaaatggacacatcgcagatcgaattattgcaatgccaagtcatatcggtggtgaacacgcaatttcaggtattaagtggataggtagtaagcacgacaatccatcgaaacgtaatatggagcgtgcaagtggcgtcattattttgaatgatccagaaacgaattatccaattgcagttatggaagcaagtttaattagtagtatgcgtactgcagcagtttcagtgattgcagcaaagcatttggctaaaaaaggatttaaagacttaacaatcattggatgcgggctaatcggagacaagcaattacaaagtatgttagagcaattcgatcatattgaacgcgtgtttgtttacgatcaattctctgaagcatgtgcacgctttgttgatagatggcaacaacagcgtccggaaattaattttattgcgacagaaaatgctaaagaagcagtatcaaatggtgaagtagtcattacatgtaccgtaacggatcaaccatacattgaatatgattggttacaaaagggtgcatttattagcaacatttctatcatggatgtgcataaagaagtctttattaaagctgacaaagtcgtagtagatgactggtcacaatgtaatcgagaaaagaaaactattaaccaattggtgttagaaggtaaattcagcaaagaagctcttcatgctgaactaggacaacttgtgacaggtgacataccaggacgtgaagacgatgatgagatcatattacttaatccgatgggtatggctatcgaagatatttcaagtgcttattttatttatcaacaggcacaacaacaaaatattgggacaacattgaacctatat

SEQ ID NO: 208 - DNA, 1143 bp, Staphylococcus aureus
atgaaaaaaattatggttattttcggtacgagacccgaagcaataaaaatggcaccattagtaaaagaaattgatcataatgggaactttgaagcgaacattgtgattacagcacaacatagagatatgttagatagtgtgttaagtatatttgatattcaagctgatcatgatttaaatattatgcaagatcaacaaacattagcaggccttacggcgaatgcacttgctaaacttgatagcatcattaatgaggaacaaccggatatgattttagtacatggtgatactacaacgacttttgtaggaagtttggcagcattttatcatcaaattccggtcggacatgtagaagctggacttcgaacacatcagaaatactcaccatttcctgaagagttaaatcgagtcatggtaagtaatattgctgaattgaattttgcgccaacagtaattgcagctaaaaatttactttttgaaaacaaagacaaagagcgtatctttattactggaaatacagttattgacgcattgtcaacaacagttcaaaatgattttgtttcaacgattattaataaacataaaggcaagaaagttgttttactaacagcgcatcgtcgtgaaaatattggggaaccgatgcatcagatttttaaagcagtaagagatttggcagatgaatataaagatgttgtcttcatttatccaatgcatcgtaatccaaaggtaagagcgattgccgaaaaatatttatctgggagaaatcggattgaattaattgagccattagatgcgattgagttccataattttacaaatcaatcgtacctcgtgctgacagattctggtggtattcaagaggaggctcctacatttggaaaacctgtgttggtattaaggaatcatacagagcgtcccgaaggcgttgaggcgggaacatcgagagtaattggcacagattatgacaatattgttcgaaatgtgaaacaattgattgaggatgatgaagcgtatcaacgtatgagtcaagcgaataatccatatggtgatggacaagcatcacgacgtatttgtgaagcaatagaatattattttggattgcgcacagacaagccggatgaattcgtacctttacgtcacaaa

SEQ ID NO: 209 - DNA, 7173 bp, Staphylococcus aureus
atgattatgggtaatttgagatttcaacaggaatattttcgtatatacaaaaataatacagaatcaacgacacaccgtaatgcgtattgggttaaactcgctaaaaatgttgaagctactaaaatgatgtatgcattatcgacaattgtgcaacaacatgcatctataagacatttttttgatgttactaccgatgacaatttaacaatgatacttcatgaatttctgccttttattgagataaaacaagttccatcttcttccgcaaactatgatttagaagctttttttaagcaagaattaagtacttaccattttaatgattcacctttattcaaagttaaattgtttcagttcgctgatgctgcatatatactattagattttcatgtgtccattttcgatgatagtcaaattgatatttttcttgatgatttatgcaatgcatatcgtggcaatactgttattaacaatactcgacagcatgcacatataaatagaaatgatgataaagacaatcaagatgcatcgcatatagcattagactcaaactattttcggttagagaataactctgacatccatattgatagttattttccaattaagcatccatttgaacaagctttatatcaaacgtatttgattgatgatatgacatcaatagatatggcatcgttggctgttagtgtgtatttagctaatcatataatgagtcaacaacatgatgtcacattaggtatacatgtaccatcacatttaccaaatgatttacacggaaatattgtgccgttaacgttaacaatcgatgcaaaagatgtatgtcaacgttttacaacagattttaataaatgtgtgttgcaaaatatgtcgcaattacagtgcgcgaagtcttcgctttcactagagactatttttcattgttatcatcatatgatgtcttgttgtaatgatgttattgaggatgtacatcaaatacatgatgcacatacatctttagcggatattgaaatttttccacatcaacacgggttcaaaattatatataacagtgcagcatatgatttgctctcaatcgagacgctgagtgacttagttcgaaatatttatttgcaaattactgaagaaaatggaaataaacgaacaactgtagatgaacttaatttgatgacagaacgtgatattcaattatatgacgatatcaatttaagtttgcctgagatagatgatgcgcaaacagttgttaccttatttgagcaacaagttgaagcaacgccgaatcatgtcgctgtgcaatttgacggagtgtttataacatatcaaacattgaatgcacgcgcgaatgatttagcacaccgtttgagaaaccagtatggtgttgaacctaatgatcgtgtcgctgtcatagctgaaaaaagtattgagatgataatagcgatgataggtgtgttgaaagctggtggggcttacgtgccaattgatccgaactatccaagtgatcgtcaggagtacattttaaaagatgtaacgcctaaagttgtaataacgtaccaagctttatatgaaaatggtaaacaaaatattaatcacattgatttgaataagatagcgtggaaaaatattgataatctttctaaatgtaacacgttagaagatcatgcttatgttatttacacgtcggggacaactggtaaccctaaagggacactaattccgcaccgaggtattgttcgcttggtccatcaaaatcattatgtaccattaaatgaagagacgacgattttgttatcaggaactatagcctttgatgctgcaacatttgaaatatatggtgcattgctcaatggtggaaagctgattgttgctaaaaaagaacaattattaaatccaatagcggtagaacaattaatcaatgaaaatgacgttaatactatgtggttaacctcctcattatttaatcagattgctagtgaacgaatagaagtattggtatcgttaaagtatttattaattggtggagaagtattgaatgctaagtgggtggatttgcttaatcaaaaaccgaagcatcctcaaattattaatggttatggaccaactgaaaatacaacatttacaacgacgtataatatacctaacaaagttccaaatcgtattcctattggtaaaccgattctgggtactcatgtttatatcatgcaaggcgagcgtcggtgtggcgttggtattcctggagaattatgtacaagtggctttgggttagctgcaggttatttaaatcagccagaattgacagcagataaatttatcaaagattcaaatataaatcagctgatgtatagaagtggtgatatcgttcgtttgttacccgatggcaacatagattatttatatcgaaaggacaaacaagttaagattcgagggtttaggattgagttgtcagaggttgagcatgcgctcgagcgtatacaaggtattaataaagcagttgttattgttcaaaatcatgatcaagatcagtatatcgttgcttattatgaagcgatgcatacattatcacataataagattaaatcacaattacgtatgaccttaccggagtacatgataccagttaatttcatgcatattgagcaaattcctattactattaatgggaaattagataagaaggcattgcctatcatggactatgtcgatacggatgcctatgtagcaccgagtacagataccgaacacttgctatgccaaatttttgcagatattttacatgtgaatcaagtaggtattcatgataatttctttgaattaggtggccattcattaaaagcaacgttagtggtgaatcggatagaggcatctactgggaaacgattacaaattggtgatttattacaaaagccaactgtatttgaactagcacaagcgattgctaaggttcaagaacaaaactatgaagtgattccagaaactatagttaaagatgattatgtgctgagctctgcacaaaagcgtatgtatttattatggaaatcaaaccataaagatacggtgtataacgtaccttttttatggcggttatcatcagaacttaatgtagctcaattgcgacaagcagtgcagcgtttgatagcgcgacatgagattttacgaacacaatatattgttgtagatgatgaggttcgacaacgtattgtggcagatgttgcagttgactttgaagaagttaacacgcattttacggatgaacaagaaatcatgcgccaatttgtagcaccttttaatttggaaaagccaagtcaaattagagtgagatacattagaagtcccttacatgcatacctctttatagatacgcatcatatcattaatgacggtatgagtaatatacaattaatgaatgatcttaacgcactttatcaacataaattattgttaccacttaaattgcaatataaagactatagtgagtggatgtcgcatcgtgatatgacgaaacatagacaatattggttatctcaattcaaagatgaagtacctattttaagcttaccgacagactatgttagaccaaatattaaaacgacaaatggagcaatgatgtcatttacaatgaatcaacaaatgagacagctacttcaaaagtatgtagaaaagcatcaaattactgattttatgttctttatgagtgtggtcatgacgttgttaagtagatatgctcgaaaagatgatgttgttgtcggtagtgtgatgagtgcgcgtatgcataaaggcacggagcaaatgctaggcatgtttgctaatacgttggtatatagagggcaaccgtcacctgataaaatgtggacacagtttttacaagaggttaaggaaatgagtttggaggcatacgagcatcaagaatacccattcgaatgtttagtaaatgacttagatcaatcacatgatgcctcacggaatccattatttgatgtcatgttagtactacaaaacaatgaaacgaatcatgctcattttgggcatagtaaattaacacacattcaacccaaatcagtgacggcgaaatttgatttatctttcatcattgaagaagatcgcgatgactatacaatcaatatcgagtataataccgatttatatcactcagaaacagttcgtcacatgggtaatcaatgtatgattatgattgattatattttgaagcatcaagatacactacaaatttgtgatataccaaacggcacggaggaacttctaaattgggtcaatacgcatgttaacgatcgaatgcttaatgtcccgggaaataaatctatcataagttactttaatgaagttgtctcacgacaaggtaatcatgttgcgctagtcatgaatgatttgacaatgacgtatgaaacattacgcaactatgtggatgccattgcgcacatgctcctatcaaatggtgtgggcaatggtcaacgggttgccttgtttacagaacgtagttttgaaatgattgcggcgatgttggcgacagttaaagtaggtgcatcttatatacctatcgatattgattttccgaataaacgacaaggtgcaattttggaggatgctaaagtaactgcagtcatgtcttacggcgttgaaattgaaacgacattaccagtcattcaattggaaaatgctaaaggctttgttgaatcaaaggaaaatgaacaatatgatgatttacatggcaatcaacttgaaaacacagcgatgttagataatgagatgtatgctatttacacatctggtacgaccgggatgcctaaaggggttgccatacgacaacgaaatttgttgaatttagtgcatgcatggtcaactgaattgcaattaggcgacaatgaagtatttttgcaacatgcaaatattgtttttgatgcatcagttatggagatttattgttgtttgttaaatggtcatacgcttgtgattccagatagagaggaacgtgttaatccagaacagttacaacaactcattaataagcatcgtgtgacggttgcgtcgattccgttacagatgtgtagtgttatggaagacttttatattgaaaagttgattacaggcggggcaactagtacggcatcctttgttaaatatattgagaagcattgtggcacgtatttcaatgcctatggaccatctgagtcaacagtcatcacatcgtattggtcacatcattgtggtgatttgatacctgagacgattccaattggcaaacccttatctaacatccaagtgtatattatgtcagatggtttgttatgcggtattggtatgccaggcgagttgtgtattgcaggtgatagtttagcgataggatatattaatcgtccagaattaatggctgataaatggcaaaataatccatttggtaaaggaaagttgtatcatagtggtgatttagcacgttatacatctgatggtcaaattgaatttttaggaagaatagataaacaagtgaaagttaacgggtaccgtattgaacttgatgaaattgaaaatgcaatattagctattcgtggtatatctgattgtgttgtaacagtaagtcactttgatacgcatgatatattgaatgcttattatgtcggagagcaacaagtggaacaggatttgaagcaatatttaaatgatcagctgcctaagtatatgattcctaagactataacgcatatcgattgtatgccattaaccacgaatgacaaggtggatactacgcgtttgccaaatccatcacctatacaacagtctaataaagtgtatagcgaaccctctaatgaaattgagcagacatttgttgatgtatttggagaggtattgaaacaaaatgatgtcggtgttgacgatgatttctttgaacttggtggtaactcattagaggcgatgttagttgtctcgcatttaaaacgatttggccatcatatttcaatgcagacattataccaatataaaaccgtgcgacagattgttaattatatgtaccaaaatcaacaatcattagttgcattaccggataatctttcggaattacaaaagattgttatgtctcgttataacttgggtattttagaggatagtctaagtcatcgacctctaggaaatacactattgactggcgcgacaggttttttaggtgcttatctgattgaagtactacaaggatacagtcatcgcatttattgtttcatacgtgctgataatgaggaaatagcatggtataagttgatgacgaatttaaatgattatttttcagaagagacggttgaaataatgttatcaaacattgaagtcattgttggtgatttcgagtgtatggatgatgttgttttaccagaaaacatggatacgattattcatgcaggtgctcgtacagatcactttggtgatgatgatgaatttgaaaaagtaaatgttcaaggtactgttgatgtcatacgtttggcacaacaacatcatgcaaggttaatatatgtgtctacgataagtgtgggaacttattttgatatagacacagaagatgtgacattttcagaagcggatgtctataaagggcaactactaacatcaccatatacacggagcaaattttatagtgaattaaaagtattagaagctgtaaataatggcttagatggtcggattgtacgtgttggtaatttgacgaatccttacaatggaagatggcatatgagaaatataaagactaaccgtttttcaatggtaatgaatgatttgttacaactggattgtatcggggttagcatggctgaaatgcctgtagatttttcttttgtggatacgactgcaagacaaattgtcgcattagcacaggtcaacacaccacaaatcatttaccatgtgctatcacctaataaaatgccggtgaaatctttgttagaatgcgttaagcgcaaagaaattgaactcgtcagcgatgaatcatttaatgaaattttacagaaacaagacatgtacgaaacgattggattaactagtgttgaccgtgaacaacaactagcaatgatagatacaacattaacattaaaaataatgaatcacatcagtgaaaaatggccaacgataactaacaattggctgtatcattgggcacaatatatcaaaacaatattcaataag

SEQ ID NO: 210 - DNA, 1452 bp, Staphylococcus aureus
atgaccaaagaacaacaacttgcagaacgaattattgctgcagtaggtggtatggataatatagatagtgtcatgaactgtatgacacgtgtgcgtattaaagtattagatgagaataaagtagatgaccaagaactaaggcatattgatggtgtcatgggtgttatacacgatgaacgcattcaagttgtggttggacctggtacagtcaataaagtggctaatcatatggcggaattaagtggtgttaaactaggtgacccaataccacaccatcacaatgatagtgaaaaaatggactataaatcatatgcagctgataaagcaaaggcgaataaggaagcgcataaagcaaaacaaaagaatggtaagttgaataaagtattgaaatcaattgccaatatctttataccgttgattcctgcatttattggagctggattaattggtggtattgcagcagtactgagtaacttaatggtggcaggctatatttcaggtgcttggattacgcaacttataacagtatttaatgtcattaaagacggtatgttagcatacttagctattttcactggtattaatgcggctaaagaatttggtgcgacaccaggacttggtggcgtgattggtggtacaacgttattaacgggtattgctggtaaaaatattttaatgaatgtcttcactggagaaccattgcaacctggacaaggtgggattattggcgttatttttgccgtttggattttaagtattgtcgaaaagagattacataaaattgtgccaaatgcgattgatattattgtaacgccgactattgcattgttgattgtaggactattaactatctttatctttatgccattagcaggttttgtttcagacagtttagtttcagtagttaacggaattattagtattggtggcgtatttagtggatttatcattggtgcaagcttcctaccgttagttatgttagggcttcatcatatttttacgccaattcatatagaaatgattaaccaatcaggtgctacttacttattgccaattgcagcgatggctggtgctggacaagtaggtgccgcattagcactttgggtaagatgtaaacgcaacacaacattacgtaatactttaaaaggtgcattgccagttggtttcctaggtatcggagaaccattaatctatggtgtgactttgccattaggtcgacctttcttaactgcttgtattggtggtggtattggtggcgctgtaataggtggaattggacatattggtgccaaagcaataggcccaagtggtgtgtcactattaccattaatctcagataatatgtatttaggttatattgcaggattacttgctgcgtatgctggtggattcgtttgtacatatttatttggaacgacaaaggcgatgcgacagacagatttgttgggtgat

SEQ ID NO: 211 - DNA, 1269 bp, Staphylococcus aureus
atgtctaaaattttaaaatgtatcacgttagccgtggtaatgttattaatcgtaactgcatgtggccctaatcgttcgaaagaagatattgataaagcattgaataaagataattctaaagacaagcctaaccaacttacgatgtgggtggatggcgacaagcaaatggcgttttataaaaaaattacggatcaatatactaaaaaaactggcatcaaagtaaagcttgtaaatattggtcaaaatgatcaactagaaaatatttcgctagacgctcctgcaggaaaaggtccagatatctttttcttagcacatgataatactggaagtgcctatctacaaggcttagctgctgaaatcaaattatcaaaagatgagttgaaaggtttcaataagcaagcacttaaagcgatgaattatgacaataagcaactagcattgccagctatcgttgaaacaaccgcacttttttataataaaaaattagtgaaaaatgcaccgcaaacgttagaagaagttgaagctaatgctgccaaactaactgatagtaaaaagaaacaatacggtatgttatttgatgctaaaaatttctattttaattatccgtttttattcggcaatgatgattatattttcaagaaaaatggcagtgaatatgatattcatcagctaggactaaattcaaaacatgtcgtcaagaatgctgaacgattacaaaaatggtacgacaaagggtatcttcctaaggcagcaacacatgatgtcatgattggtctttttaaagaaggaaaagtaggacaatttgtcactggaccgtggaacattaatgaatatcaagaaacgtttggtaaagatttaggagtaacaacattacctacagatggtggcaaacctatgaaaccatttctaggtgtacgtggttggtatttatctgaatatagtaaacataagtattgggctaaagatttaatgctgtatatcactagtaaagatacattacaaaaatatacagatgaaatgagcgaaattactggacgtgttgacgtgaaatcatctaatccaaatttaaaagtgtttgaaaagcaagcacgtcatgctgaaccgatgcctaatattcctgaaatgcgacaagtttgggaaccgatgggcaatgcaagcatatttatttcaaatggtaagaatcctaaacaagcgttagatgaggcgacgaatgatataacgcaaaatattaagattcttcatccatcacaaaatgataagaaaggagat

SEQ ID NO: 212 - DNA, 1041 bp, Staphylococcus aureus
gtgaaagcattgaaattatatggcgtggaagatttacggtatgaggataatgaaaagccagtcattgaaagtgcgaatgacgttattattaaagtacgagcgactggcatatgtggttcagacacgtcacgatacaaaaaaatggggccatacattaaaggtatgccatttggtcatgaattttcaggtgtagtagatgccattggaagtgatgttacgcatgttaatgtgggcgacaaagtgacaggttgcccagcaataccttgttatcaatgcgagtattgtttaaaaggtgaatatgcacgatgtgaaaagttattcgtcattggctcatatgaacctggatcgttcgcggaatatgtcaaattgccagcgcaaaatgttttaaaggttccagacaatgttgattacattgaagcagcaatggttgagccatcagccgttgttgcgcatgggttttataaatcgaatatacaacctggtatgactgttgcagtaatggggtgtggcagtataggtttgttagctattcaatgggcacgaatatttggtgctgcacatatcatcgctatagatatagatgcgcataaactagatattgcaacatcattgggcgcacatcaaacaatcaattcaaaagaagaaaatcttgagaaattcatcgaaaatcattacgccaatcaaatcgatttagctatagaatcatcaggtgctaaagttacgattggtcaaatattgacgctacctaaaaaaggtggcgaggtggtattactcggaataccatatgatgatattgagattgatcgcgttcattttgaaaaaattctgcgtaacgagttgacagtatgtggctcttggaactgtttgtccagtaattttccgggcaaagagtggacggcaaccttacattatatgaagacgaaagatattaatgtaaagcctattatttctcattttttaccgttagaaaaaggcccggagacatttgataaattagttaacaagaaagaacgatttgataaagtcatgtttacgatttat

SEQ ID NO: 213 - DNA, 789 bp, Staphylococcus aureus
atgcaagcattacaaacatttaattttaaagagctaccagtaagaacagtagaaattgaaaacgaaccttattttgtaggaaaagatattgctgagattttaggatatgcaagatcagacaatgccattagaaatcatgttgatagcgaggacaagctgacgcaccaatttagtgcatcaggtcaaaacagaaatatgatcattatcaacgaatcaggattatacagtctaatcttcgatgcttctaaacaaagcaaaaacgaaaaaatcagagaaaccgctcggaaattcaaacgatgggtaacatcagatgtcctaccagctattcgcaaacacggtatatacgcaacagacaatgtaattgaacaaacattaaaagatccagactacatcattacagtgttgactgagtataagaaagaaaaagagcaaaacttacttttacaacaagaaatcggagaactaaaacccaaagcagactatgtagatgaaatcttaaagtcaactggcacattagccacaactcaaatcgcggcagactacggtatatcagcacaaaagttaaacaaactactacacgaagctagactacaacgaaaagtaaataaacagtgggtgctttactcagaacacatgggcaagagttacacagaatcagacactatagcaattgtacgctctgacggtagagaagacacagttttacaaactagatggacacaaaaaggcagattgaaaatacatgaaatcatgactgaattcggttatgaagctaatttagggggagcg

SEQ ID NO: 214 - DNA, 570 bp, Staphylococcus aureus
atgaaattaaaatcattagcagtgttatcaatgtcagcggtggtgcttactgcatgtggcaatgatactccaaaagatgaaacaaaatcaacagagtcaaatactaatcaagacactaatacaacaaaagatgttattgctttaaaagatgttaaaacaagcccagaagatgctgtgaaaaaagctgaagaaacttacaaaggccaaaagttgaaaggaatttcatttgaaaattctaatggtgaatgggcttataaagtgacgcaacaaaaatctggtgaagagtcagaagtacttgttgctgataaaaataaaaaagtgattaacaaaaagactgaaaaagaagatacaatgaatgaaaatgataactttaaatatagcgatgctatagattacaaaaaagccattaaagaaggacaaaaagaatttgatggtgatattaaagaatggtcacttgaaaaagatgatggcaaacttgtttacaatatcgatttgaaaaaaggtaataaaaaacaagaagttactgttgatgctaagaacggtaaagtattaaagagtgagcaagatcac

SEQ ID NO: 215 - DNA, 693 bp, Staphylococcus aureus
atgaaaatgaaaaatattgcaaaaataagtttgttattaggaatattagcaacaggtgtaaacactacaacggaaaaaccagttcatgccgaaaagaaacctattgtaataagtgaaaatagcaaaaaattaaaagcttattataatcaacctagtattgaatataaaaatgtgacaggttatatcagtttcattcaaccaagtattaaatttatgaatatcatagatggtaattctgttaataatattgctttaattggcaaagataagcaacattatcatacgggtgtacatcgtaatcttaatatattttacgttaatgaggataagagatttgaaggtgcaaagtactctattgggggtatcacgagtgcaaacgataaagctgtcgacctaatagcagaagcaagagttattaaagaagatcatactggtgaatatgattatgactttttcccatttaaaatagataaagaagcgatgtcattgaaagagattgattttaaattaagaaaataccttattgataattatggtctttacggtgaaatgagtacaggaaaaattacagtcaaaaagaaatactatggaaagtatacatttgaattggataaaaagttacaagaagaccgtatgtccgatgttatcaatgtcacagatattgatagaattgaaatcaaagttataaaagca

SEQ ID NO: 216 - protein, 585 aa, Staphylococcus aureus
MRKTKIVCTIGPASESEEMIEKLINAGMNVARLNFSHGSHEEHKGRIDTIRKVAKRLDKIVAILLDTKGPEIRTHNMKDGIIELERGNEVIVSMNEVEGTPEKFSVTYENLINDVQVGSYILLDDGLIELQVKDIDHAKKEVKCDILNSGELKNKKGVNLPGVRVSLPGITEKDAEDIRFGIKENVDFIAASFVRRPSDVLEIREILEEQKANISVFPKIENQEGIDNIAEILEVSDGLMVARGDMGVEIPPEKVPMVQKDLIRQCNKLGKPVITATQMLDSMQRNPRATRAEASDVANAIYDGTDAVMLSGETAAGLYPEEAVKTMRNIAVSAEAAQDYKKLLSDRTKLVETSLVNAIGISVAHTALNLNVKAIVAATESGSTARTISKYRPHSDIIAVTPSEETARQCSIVWGVQPVVKKGRKSTDALLNNAVATAVETGRVSNGDLIIITAGVPTGETGTTNMMKIHLVGDEIANGQGIGRGSVVGTTLVAETVKDLEGKDLSDKVIVTNSIDETFVPYVEKALGLITEENGITSPSAIVGLEKGIPTVVGVEKAVKNISNNMLVTIDAAQGKIFEGYANVL

SEQ ID NO: 217 - protein, 393 aa, Staphylococcus aureus
MQFDNIDSALMALKNGEPIIVVDDENRENEGDLVAVTEWMNDNTINFMAKEARGLICAPVSKDIAQRLDLVQMVDDNSDIFGTQFTVSIDHVDTTTGISAYERTLTAKKLIDPSSEAKDFNRPGHLFPLVAQDKGVLARNGHTEAAVDLAKLTGAKPAGVICEIMNDDGTMAKGQDLQKFKEKHQLKMITIDDLIEYRKKLEPEIEFKAKVKMPTDFGTFDMYGFKATYTDEEIVVLTKGAIRQHENVRLHSACLTGDIFHSQRCDCGAQLESSMKYINEHGGMIIYLPQEGRGIGLLNKLRAYELIEQGYDTVTANLALGFDEDLRDYHIAAQILKYFNIEHINLLSNNPSKFEGLKQYGIDIAERIEVIVPETVHNHDYMETKKIKMGHLI

SEQ ID NO: 218 - protein, 327 aa, Staphylococcus aureus
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWVGNNYKNQNTVTFTSTYEVDWQNHTVKLIGTDSKETNPGV

SEQ ID NO: 219 - protein, 290 aa, Staphylococcus aureus
MKKKALLPLFLGIMVFLAGCDYSKPEKRSGFFYNTFVDPMKNVLDWLGNNLLNDNYGLAIIILVLVIRIILLPFMLSNYKNSHMMRQKMKVAKPEVEKIQEKVKRARTQEEKMAANQELMQVYKKYDMNPIKSMLGCLPMLIQLPIIMGLYFVLKDQLVDGLFKYPHFLWFDLGRPDIWITIIAGVLYFIQAYVSSKTMPDEQRQMGYMMMVISPIMIIWISLSSASALGLYWSVSAAFLVVQTHFANIYYEKVAKKEVQPFIEAYEREHNGGSNKKGKNTQVVSKKKKK

SEQ ID NO: 220 - protein, 2478 aa, Staphylococcus aureus
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNLSQKDDTATADTNDTQKSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 221 - protein, 141 aa, Staphylococcus aureus
MKLKSFVTATLALGLLSTVGAALPSHEASADSNNGYKEMTVDGYHTVPYTISVDGITALHRTYFIFPENKNVLYQEIDSKVKNELASQRGVTTEKINNAQTATYTLTLNDGNKKVVNLKKNDDAKNSIDPSTIKQIQIVVK

SEQ ID NO: 222 - protein, 277 aa, Staphylococcus aureus
MAIKKYKPITNGRRNMTSLDFAEITKTTPEKSLLKPLPKKAGRNNQGKLTVRHHGGGHKRQYRVIDFKRNKDGINAKVDSIQYDPNRSANIALVVYADGEKRYIIAPKGLEVGQIVESGAEADIKVGNALPLQNIPVGTVVHNIELKPGKGGQIARSAGASAQVLGKEGKYVLIRLRSGEVRMILSTCRATIGQVGNLQHELVNVGKAGRSRWKGIRPTVRGSVMNPNDHPHGGGEGRAPIGRPSPMSPWGKPTLGKKTRRGKKSSDKLIVRGRKKK

SEQ ID NO: 223 - protein, 532 aa, Staphylococcus aureus
MLVNTFNPFDNLLLSSLIAAIPIVLFLLCLTVFKMKGIYAAITTLVVTLLIAIPFFKLPVGIASGAVVEGFFQGIIPIGYIVMMAVLLYKITVESGQFLTIQDSITNISQDQRIQVLLIGFAFNAFLEGAAGFGVPIAICALLLTQLGFNPLKAAMLCLVANAASGAFGAIGIPVGVVETLKLPGDVSVLGVSQSATLTLAIINFIIPFLLIFIIDGFRGVKETLPAILVVSITYTLTQGLLTVFSGPELADIIPPLLTMLALAVFSKKFQPKHIYRVNKDEEIEPAKAHSAKAVLHAWSPFIVLTVIVMIWSAPFFKNLFLPNGALSSLVFKFNLPGTISEVTHKPLVLTLNIIGQTGTAILLTIIITILMSKKVNFKDAGRLFGVTFKELWLPVLTICFILAISKITTYGGLSAAMGQGIAKAGNVFPVLSPILGWIGVFMTGSVVNNNSLFAPIQASVAQQIGTSGSLLVSANTVGGVAAKLISPQSIAIATAAVKQVGKESELLKMTLKYSVCLLIFICIWTFILSLL

SEQ ID NO: 224 - protein, 315 aa, Staphylococcus aureus
MLKNKILTTTLSVSLLAPLANPLLENAKAANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQILGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 225 - protein, 325 aa, Staphylococcus aureus
MKMNKLVKSSVATSMALLLLSGTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 226 - protein, 336 aa, Staphylococcus aureus
MNREMLYLNRSDIEQAGGNHSQVYVDALTEALTAHAHNDFVQPLKPYLRQDPENGHIADRIIAMPSHIGGEHAISGIKWIGSKHDNPSKRNMERASGVIILNDPETNYPIAVMEASLISSMRTAAVSVIAAKHLAKKGFKDLTIIGCGLIGDKQLQSMLEQFDHIERVFVYDQFSEACARFVDRWQQQRPEINFIATENAKEAVSNGEVVITCTVTDQPYIEYDWLQKGAFISNISIMDVHKEVFIKADKVVVDDWSQCNREKKTINQLVLEGKFSKEALHAELGQLVTGDIPGREDDDEIILLNPMGMAIEDISSAYFIYQQAQQQNIGTTLNLY

SEQ ID NO: 227 - protein, 381 aa, Staphylococcus aureus
MKKIMVIFGTRPEAIKMAPLVKEIDHNGNFEANIVITAQHRDMLDSVLSIFDIQADHDLNIMQDQQTLAGLTANALAKLDSIINEEQPDMILVHGDTTTTFVGSLAAFYHQIPVGHVEAGLRTHQKYSPFPEELNRVMVSNIAELNFAPTVIAAKNLLFENKDKERIFITGNTVIDALSTTVQNDFVSTIINKHKGKKVVLLTAHRRENIGEPMHQIFKAVRDLADEYKDVVFIYPMHRNPKVRAIAEKYLSGRNRIELIEPLDAIEFHNFTNQSYLVLTDSGGIQEEAPTFGKPVLVLRNHTERPEGVEAGTSRVIGTDYDNIVRNVKQLIEDDEAYQRMSQANNPYGDGQASRRICEAIEYYFGLRTDKPDEFVPLRHK

SEQ ID NO: 228 - protein, 2391 aa, Staphylococcus aureus
MIMGNLRFQQEYFRIYKNNTESTTHRNAYWVKLAKNVEATKMMYALSTIVQQHASIRHFFDVTTDDNLTMILHEFLPFIEIKQVPSSSANYDLEAFFKQELSTYHFNDSPLFKVKLFQFADAAYILLDFHVSIFDDSQIDIFLDDLCNAYRGNTVINNTRQHAHINRNDDKDNQDASHIALDSNYFRLENNSDIHIDSYFPIKHPFEQALYQTYLIDDMTSIDMASLAVSVYLANHIMSQQHDVTLGIHVPSHLPNDLHGNIVPLTLTIDAKDVCQRFTTDFNKCVLQNMSQLQCAKSSLSLETIFHCYHHMMSCCNDVIEDVHQIHDAHTSLADIEIFPHQHGFKIIYNSAAYDLLSIETLSDLVRNIYLQITEENGNKRTTVDELNLMTERDIQLYDDINLSLPEIDDAQTVVTLFEQQVEATPNHVAVQFDGVFITYQTLNARANDLAHRLRNQYGVEPNDRVAVIAEKSIEMIIAMIGVLKAGGAYVPIDPNYPSDRQEYILKDVTPKVVITYQALYENGKQNINHIDLNKIAWKNIDNLSKCNTLEDHAYVIYTSGTTGNPKGTLIPHRGIVRLVHQNHYVPLNEETTILLSGTIAFDAATFEIYGALLNGGKLIVAKKEQLLNPIAVEQLINENDVNTMWLTSSLFNQIASERIEVLVSLKYLLIGGEVLNAKWVDLLNQKPKHPQIINGYGPTENTTFTTTYNIPNKVPNRIPIGKPILGTHVYIMQGERRCGVGIPGELCTSGFGLAAGYLNQPELTADKFIKDSNINQLMYRSGDIVRLLPDGNIDYLYRKDKQVKIRGFRIELSEVEHALERIQGINKAVVIVQNHDQDQYIVAYYEAMHTLSHNKIKSQLRMTLPEYMIPVNFMHIEQIPITINGKLDKKALPIMDYVDTDAYVAPSTDTEHLLCQIFADILHVNQVGIHDNFFELGGHSLKATLVVNRIEASTGKRLQIGDLLQKPTVFELAQAIAKVQEQNYEVIPETIVKDDYVLSSAQKRMYLLWKSNHKDTVYNVPFLWRLSSELNVAQLRQAVQRLIARHEILRTQYIVVDDEVRQRIVADVAVDFEEVNTHFTDEQEIMRQFVAPFNLEKPSQIRVRYIRSPLHAYLFIDTHHIINDGMSNIQLMNDLNALYQHKLLLPLKLQYKDYSEWMSHRDMTKHRQYWLSQFKDEVPILSLPTDYVRPNIKTTNGAMMSFTMNQQMRQLLQKYVEKHQITDFMFFMSVVMTLLSRYARKDDVVVGSVMSARMHKGTEQMLGMFANTLVYRGQPSPDKMWTQFLQEVKEMSLEAYEHQEYPFECLVNDLDQSHDASRNPLFDVMLVLQNNETNHAHFGHSKLTHIQPKSVTAKFDLSFIIEEDRDDYTINIEYNTDLYHSETVRHMGNQCMIMIDYILKHQDTLQICDIPNGTEELLNWVNTHVNDRMLNVPGNKSIISYFNEVVSRQGNHVALVMNDLTMTYETLRNYVDAIAHMLLSNGVGNGQRVALFTERSFEMIAAMLATVKVGASYIPIDIDFPNKRQGAILEDAKVTAVMSYGVEIETTLPVIQLENAKGFVESKENEQYDDLHGNQLENTAMLDNEMYAIYTSGTTGMPKGVAIRQRNLLNLVHAWSTELQLGDNEVFLQHANIVFDASVMEIYCCLLNGHTLVIPDREERVNPEQLQQLINKHRVTVASIPLQMCSVMEDFYIEKLITGGATSTASFVKYIEKHCGTYFNAYGPSESTVITSYWSHHCGDLIPETIPIGKPLSNIQVYIMSDGLLCGIGMPGELCIAGDSLAIGYINRPELMADKWQNNPFGKGKLYHSGDLARYTSDGQIEFLGRIDKQVKVNGYRIELDEIENAILAIRGISDCVVTVSHFDTHDILNAYYVGEQQVEQDLKQYLNDQLPKYMIPKTITHIDCMPLTTNDKVDTTRLPNPSPIQQSNKVYSEPSNEIEQTFVDVFGEVLKQNDVGVDDDFFELGGNSLEAMLVVSHLKRFGHHISMQTLYQYKTVRQIVNYMYQNQQSLVALPDNLSELQKIVMSRYNLGILEDSLSHRPLGNTLLTGATGFLGAYLIEVLQGYSHRIYCFIRADNEEIAWYKLMTNLNDYFSEETVEIMLSNIEVIVGDFECMDDVVLPENMDTIIHAGARTDHFGDDDEFEKVNVQGTVDVIRLAQQHHARLIYVSTISVGTYFDIDTEDVTFSEADVYKGQLLTSPYTRSKFYSELKVLEAVNNGLDGRIVRVGNLTNPYNGRWHMRNIKTNRFSMVMNDLLQLDCIGVSMAEMPVDFSFVDTTARQIVALAQVNTPQIIYHVLSPNKMPVKSLLECVKRKEIELVSDESFNEILQKQDMYETIGLTSVDREQQLAMIDTTLTLKIMNHISEKWPTITNNWLYHWAQYIKTIFNK

SEQ ID NO: 229 - protein, 484 aa, Staphylococcus aureus
MTKEQQLAERIIAAVGGMDNIDSVMNCMTRVRIKVLDENKVDDQELRHIDGVMGVIHDERIQVVVGPGTVNKVANHMAELSGVKLGDPIPHHHNDSEKMDYKSYAADKAKANKEAHKAKQKNGKLNKVLKSIANIFIPLIPAFIGAGLIGGIAAVLSNLMVAGYISGAWITQLITVFNVIKDGMLAYLAIFTGINAAKEFGATPGLGGVIGGTTLLTGIAGKNILMNVFTGEPLQPGQGGIIGVIFAVWILSIVEKRLHKIVPNAIDIIVTPTIALLIVGLLTIFIFMPLAGFVSDSLVSVVNGIISIGGVFSGFIIGASFLPLVMLGLHHIFTPIHIEMINQSGATYLLPIAAMAGAGQVGAALALWVRCKRNTTLRNTLKGALPVGFLGIGEPLIYGVTLPLGRPFLTACIGGGIGGAVIGGIGHIGAKAIGPSGVSLLPLISDNMYLGYIAGLLAAYAGGFVCTYLFGTTKAMRQTDLLGD

SEQ ID NO: 230 - protein, 423 aa, Staphylococcus aureus
MSKILKCITLAVVMLLIVTACGPNRSKEDIDKALNKDNSKDKPNQLTMWVDGDKQMAFYKKITDQYTKKTGIKVKLVNIGQNDQLENISLDAPAGKGPDIFFLAHDNTGSAYLQGLAAEIKLSKDELKGFNKQALKAMNYDNKQLALPAIVETTALFYNKKLVKNAPQTLEEVEANAAKLTDSKKKQYGMLFDAKNFYFNYPFLFGNDDYIFKKNGSEYDIHQLGLNSKHVVKNAERLQKWYDKGYLPKAATHDVMIGLFKEGKVGQFVTGPWNINEYQETFGKDLGVTTLPTDGGKPMKPFLGVRGWYLSEYSKHKYWAKDLMLYITSKDTLQKYTDEMSEITGRVDVKSSNPNLKVFEKQARHAEPMPNIPEMRQVWEPMGNASIFISNGKNPKQALDEATNDITQNIKILHPSQNDKKGD

SEQ ID NO: 231 - protein, 347 aa, Staphylococcus aureus
VKALKLYGVEDLRYEDNEKPVIESANDVIIKVRATGICGSDTSRYKKMGPYIKGMPFGHEFSGVVDAIGSDVTHVNVGDKVTGCPAIPCYQCEYCLKGEYARCEKLFVIGSYEPGSFAEYVKLPAQNVLKVPDNVDYIEAAMVEPSAVVAHGFYKSNIQPGMTVAVMGCGSIGLLAIQWARIFGAAHIIAIDIDAHKLDIATSLGAHQTINSKEENLEKFIENHYANQIDLAIESSGAKVTIGQILTLPKKGGEVVLLGIPYDDIEIDRVHFEKILRNELTVCGSWNCLSSNFPGKEWTATLHYMKTKDINVKPIISHFLPLEKGPETFDKLVNKKERFDKVMFTIY

SEQ ID NO: 232 - protein, 263 aa, Staphylococcus aureus
MQALQTFNFKELPVRTVEIENEPYFVGKDIAEILGYARSDNAIRNHVDSEDKLTHQFSASGQNRNMIIINESGLYSLIFDASKQSKNEKIRETARKFKRWVTSDVLPAIRKHGIYATDNVIEQTLKDPDYIITVLTEYKKEKEQNLLLQQEIGELKPKADYVDEILKSTGTLATTQIAADYGISAQKLNKLLHEARLQRKVNKQWVLYSEHMGKSYTESDTIAIVRSDGREDTVLQTRWTQKGRLKIHEIMTEFGYEANLGGA

SEQ ID NO: 233 - protein, 190 aa, Staphylococcus aureus
MKLKSLAVLSMSAVVLTACGNDTPKDETKSTESNTNQDTNTTKDVIALKDVKTSPEDAVKKAEETYKGQKLKGISFENSNGEWAYKVTQQKSGEESEVLVADKNKKVINKKTEKEDTMNENDNFKYSDAIDYKKAIKEGQKEFDGDIKEWSLEKDDGKLVYNIDLKKGNKKQEVTVDAKNGKVLKSEQDH

SEQ ID NO: 234 - protein, 231 aa, Staphylococcus aureus
MKMKNIAKISLLLGILATGVNTTTEKPVHAEKKPIVISENSKKLKAYYNQPSIEYKNVTGYISFIQPSIKFMNIIDGNSVNNIALIGKDKQHYHTGVHRNLNIFYVNEDKRFEGAKYSIGGITSANDKAVDLIAEARVIKEDHTGEYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 235 - DNA, 681 bp, Staphylococcus aureus
ttgaaaaatattttaaaagtttttaatacaacgattttagcgttaattatcatcatcgcgacattcagtaattctgcaaatgccgcagatagcggtactttgaattatgaggtttacaaatacaataccaatgacacgtcaattgctaatgactattttaataaaccggcaaagtacattaagaaaaatggtaaattgtatgttcaaataactgtcaaccacagtcattggattactggaatgagtatcgaaggacataaagaaaatattattagtaaaaacactgccaaagatgaacgcacttctgaatttgaagtaagtaagttgaacggtaaaatagatggaaaaattgacgtttatatcgatgaaaaagtaaatggaaagccattcaaatatgaccatcattacaacattacatataaatttaatggaccaactgatgtagcaggtgctaatgcaccaggtaaagatgataaaaattctgcttcaggtagtgacaaaggatctgatggaacgactactggtcaaagtgaatctaatagttcgaataaagacaaagtagaaaatccacaaacaaatgctggtacacctgcatatatatatacaataccagttgcatccttagcattattaatcgcaatcacattgtttgttagaaaaaaatctaaaggcaatgtggaa

SEQ ID NO: 236 - DNA, 1050 bp, Staphylococcus aureus
atgacaaaacattatttaaacagtaagtatcaatcagaacaacgttcatcagctatgaaaaagattacaatgggtacagcatctatcattttaggttcccttgtatacataggcgcagacagccaacaagtcaatgcggcaacagaagctacgaacgcacctaataatcaaagcacacaagtttctcaagcaacatcacaaccaattaatttccaagtgcaaaaagatggctcttcagagaagtcacacatggatgactatatgcaacaccctggtaaagtaattaaacaaaataataaatattatttccaaaccgtgttaaacaatgcatcattctggaaagaatacaaattttacaatgcaaacaatcaagaattagcaacaactgttgttaacgataataaaaaagcggatactagaacaatcaatgttgcagttgaacctggatataagagcttaactactaaagtacatattgtcgtgccacaaattaattacaatcatagatatactacgcatttggaatttgaaaaagcaattcctacattagctgacgcagcaaaaccaaacaatgttaaaccggttcaaccaaaaccagctcaacctaaaacacctactgagcaaactaaaccagttcaacctaaagttgaaaaagttaaacctactgtaactacaacaagcaaagttgaagacaatcactctactaaagttgtaagtactgacacaacaaaagatcaaactaaaacacaaactgctcatacagttaaaacagcacaaactgctcaagaacaaaataaagttcaaacacctgttaaagatgttgcaacagcgaaatctgaaagcaacaatcaagctgtaagtgataataaatcacaacaaactaacaaagttacaaaacataacgaaacgcctaaacaagcatctaaagctaaagaattaccaaaaactggtttaacttcagttgataactttattagcacagttgccttcgcaacacttgcccttttaggttcattatctttattacttttcaaaagaaaagaatctaaa

SEQ ID NO: 237 - protein, 227 aa, Staphylococcus aureus
LKNILKVFNTTILALIIIIATFSNSANAADSGTLNYEVYKYNTNDTSIANDYFNKPAKYIKKNGKLYVQITVNHSHWITGMSIEGHKENIISKNTAKDERTSEFEVSKLNGKIDGKIDVYIDEKVNGKPFKYDHHYNITYKFNGPTDVAGANAPGKDDKNSASGSDKGSDGTTTGQSESNSSNKDKVENPQTNAGTPAYIYTIPVASLALLIAITLFVRKKSKGNVE

SEQ ID NO: 238 - protein, 350 aa, Staphylococcus aureus
MTKHYLNSKYQSEQRSSAMKKITMGTASIILGSLVYIGADSQQVNAATEATNAPNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 239 - DNA, 5610 bp, Staphylococcus epidermidis
atgacaaagaaagaaaaggattataaaaaaagtcttgagcaacaaaaaacacgggtaaaaatatacaagtcaggaaaaagctgggtaaaagcaagtattaatgaaatagaattgttaaaaacaatggggctaccatttttaagtaaaaacgaaatacaagaaaatgtgactgaaaagacgaaaggtcataaattaaaaaaaagtgcagctaaaacaacagccctagttggtggagcatttacatttaatatgttgaataatcatcaagcatttgctgcctcagaaacaccaatcacctctgaaatttcatccaatagtgagacagtagccaatcaaaattcaactacgattaagaactcacaaaaagaaacagtcaattctacaagtttggaatctaaccattctaatagtacaaataagcaaatgtcttcagaagttacaaatacagctcaatccagtgaaaaagctggaattagtcaacaaagtagtgaaacatcaaatcaatcatctaagttaaatacatatgcctccacagaccatgtagagagtacaactattaacaatgataatactgcacaacaagatcaaaataagtcttcgaatgtaacctctaagtcaacacaatcaaacacgtcatcctcagaaaagaacattagctccaatttaacccagtcaatcgaaacaaaagcaaccgattcattagcgactagtgaagcacgtactagtacaaatcaaatatctaatctgacatcaacatctacttcgaatcaatcgagtcctacttcctttgcaaatttaagaacatttagtagatttactgttttgaatacgatggcagcaccgacaacaacatcaacgacaacaacttcaagtctgacatctaattctgttgtggtgaacaaagataactttaatgaacatatgaatctatctggatctgcgacgtatgatcctaaaacaggtattgctaccttaacgccagacgcatatagtcaaaagggtgccatatctttaaacactcgattagattcaaaccgtagcttccgttttataggtaaagttaaccttggtaatagatatgaaggttattctcctgatggtgtagcaggtggagatggcattggctttgcattttcaccaggccctttaggacagataggtaaagaaggggctgccgttggaataggcggtttgaataatgcctttggttttaaattggatacgtatcataacacatcaactcctagatctgatgctaaagcaaaagcagatccacgtaatgttggtggtggtggtgcttttggtgccttcgtaagtacagatagaaatggtatggctaccactgaggaatcaactgcggctaaattaaatgtacaacctactgacaattcattccaagattttgtcattgactataatggtgatacaaaagtgatgacagtgacgtacgctggacaaacctttacgagaaatcttacagattggataaaaaacagtgggggtacgacgttttctctatctatgactgcctcaactggtggcgcaaaaaatttacaacaagttcaatttggaacattcgagtatacagaatcagctgttgctaaagtacgctatgtagatgcaaatactggtaaggatattatcccgcctaaaaccattgcaggtgaagttgacgggactgtaaatatagataaacaattgaacaattttaaaaatttaggttacagttatgtggggacagatgccttaaaagcaccaaattatacagaaacgtcaggtacacctacacttaaattaactaactcaagccaaacggtgatttataaattcaaagatgttcaaggtcctcaaattagtgttgatagtcaaactagagaagttggaaagaccattaatccaattacaattactacaactgacaatagtaaagacgtattaactacaactgtgacaggtctaccttcagggttatcttttgatcaaacgactaatacaattattggcacgccaagtgaagtaggaactacaactgtgacagttaatactactgatgctactgggaacgtaacatctaagcaatttacaataacgattcaagatacaatcagccctgttgtaaatgtgacgccaagtcaagcatcagaggttttcacgccgattaatccaattacgataactgctacagataatagtggcaaagtggtaacgcatacagtaactggattgccacaaggacttaaatttgatgcatctacgaattcaattgttggaactccaactcaaataggaacaaatacaatcacgattgagtcaacggatgcgagtggaaataaaactacgactaaaattaattatgaagtaacgagaaatagcgcaagtgactctacttccactagcatagtaaatagtgtttcaacaagtataagtaatagtacatcgctaagtgatagtgtaaaagcgagtcaatcattatcaacaaaagaatcaacaagtaagagtctctcaggttcgttaagtgcgtcaacgtcgaatagtgcatcaataaaagcgagtgaatcagcaagcacaagtaagaagttatcagaatcagcgagtacgtcgatgtctgatagcgcatcaataaaagcgagcgaatcagcaagtacaagtaagaagttatcagaatcagcgagtacgtcaacgtctgatagcgcatcaataaaagcaagcgaatcagcaagtacaagtaagaagttatcagaatcagcgagtacgtcgatgtctgatagcgtatcaataaaagcgagcgaatcagcgagtacaagtaagaagttatcagaatcagcgagtacgtcgacgtctgatagcgcatcaacccaagcaagcgaatcagcaagtacaagtaaaaagttatcagaatcaacgagtacgtcgacttcagatagtgcatcaacatcaacgagtgagagtgactcaacaagtgaaagtacatcgttaagtgactcgacaagtgcgagtctttcagaatcgacaagtacatcaacatccgacagtgcgtccacatcaacgagtgagagtgactcaaacagtacaagtacgtcattgagtgagtcgacaagcacaagtctttcagaatcaacgagtacgtcaacatcagatagtgcgtcaacgtcagcaagtgtgagtgactccaatagcgcaagtacgtcattaagagaatcgacaagtacgagtctttcagactcaacaagtacatcgacatctgacagtgcgtcaacatcaacgagcgagagcgactccgatagcgcaagtacatcgttgagtggctcatcaagtacaagcgtttcagattcaacaagcgcgtcaacatcagaaagtgcatcaacgtcaacgagcataagtgactcaaacagtacaagtacgtcattaagtgaatcgacaagtacgagtctttcagaatcaacgagtacgtctacatccgacagtgcatccacatcaatgagtgtaagcgactcaaatagtgccagcatatctttaagtgagtcgacaagcacaagcgtttcagattcaacaagtacatcgacatcagaaagtgcatcaacgtcaacgagcgagagtgactccaatagcgcaagtacgtcattaagtgagtcgacaagcacaagcgtttcagattcaacaagcacatcgacatcagacagtgcgtcaacatcaacgagcgtaagtgattccaatagcgcaagtacgtcattgagtgagtcgacaagcacaagcatctcagattcaacaagcacgtcgacatcagacagtgcgtcaacatcaacaagtgtgagtgagtcaagcagtacaagtaagaagttatcagaatcagcgagtacgtcgatgtctgatagcgcatctgcatcaacgagtgaatcaaacagtacaagtacgtcattaagtggctcgacaagtacgagtctttcaggatcaacgagtacatcgacttcagaaagtgcgtcaacatcaacgagcgtaagtgactccaatagcgcaagtacgtcattaagtgaatcgacaagtacgagtctttcagactcaacgagtacatcgacatcagatagtacgtctgcatcaacaagtgagagtgactcaaacagtacaagcacatccatgagtgaatcattaagcacaagcgtttcagattcaacaagtacgtcaacgtcagacagtgcatcaacgtcaacaagtgtgagtgactccaatagcgcaagtacgtcattaagtgattcaacaagtacaagcatttcagactcaacgagtgcgtcgacatcagatagtgcgtcagagtcagcaagcgagagtgaatcaacaagtgaaagtacatcggtaagtgaatcatcaagtacaagcgtttcagattcaacaagtacatcgacatcagaaagtgcatcaacgtcaacaagcgagagtgaatcaacaagtgaaagtacatcggtaagtgaatcatcaagtacaagcgtttcagattcaacaagtacatcgacatcagaaagtgcatcaacgtcaacaagcgagagtgaatcaacaagtgaaagtacgtcattaagtggatcatcaagtacaagcgtttcagattcaacaagtacgtcaacgtcagaaagtgcatcaacgtcaacgagtgtgagcgactcaaatagtacaagtacgtcattaagtgaatcgacaagtacgagtctttcaaactcaacaagtacgtcaacatcagacagtgcatcaacgtcaacgagtgtgagcgactccaatagcgcaagtacatcgttgagtggctcattaagcacaaacgtttcagattcaacaagcacatcgacatcagacagtgcttcaacgtcaacaagcgagagtgactcgaacagtgcaagcacatcgctaagtggatcattaagtacaagcatttcagactcaacgagtacgtcgacatcagacagtgcgtccacatccacatcagaaagtgcatccacatcaacgagtgtgagtgagtcagacagtgaaagtacatccatgagtgtgagtgactcgaatagtacaagtacatcattgagtgactcgacaagtacgagcgtttcagactcaacaagaacatcaacatccgatagtgcatctacatcaaagagtgtaagtgagtcaaacagcgccagtacatcggtaagtggctcaacaagtacaagcatttcagattcatcaagcacgtccacatcaatgagtacatctgaaactttcacttctcaatctcctataaatagtgaaagtcaatttattggtgatagcttgtctgaagatacaatcgtgactcaatcaaaaaatacgaatatgcttaataaaactggaaaagattatgatttacaagaacaaagaggttatactgattcagaacaacacaatgaaacacaaagtaatcaagctgataatcactcaaacaacctcgatttacttcatcaaaatcgtttacaagataaagtcgttaaacaaccgactaaaggagaagatggagttgtaagcaacggttttatagtagcagtagcaatagtattggctatcttcggtttggcaaaaaaatctagaaaagacgatgatgatcaagatggtagtaaa

SEQ ID NO: 240 - DNA, 706 bp, Staphylococcus epidermidis
atgaaaaaaacagttatcgcttctacattagcagtatctttaggaattgcaggttacggtttatcaggacatgaagcacacgcttcagaaactacaaacgttgataaagcacacttagtagatttagcacaacataatcctgaagaattaaatgctaaaccagttcaagctggtgcttacgatattcatttcgtagacaatggataccaatacaacttcacttcaaatggttctgaatggtcatggagctacgctgtagctggttcagatgctgattacacagaatcatcatcaaaccaagaagtaagtgcaaatacacaatctagtaacacaaatgtacaagctgtttcagctccaacttcttcagaaagtcgtagctacagcacatcaactacttcatactcagcaccaagccataactacagctctcacagtagttcagtaagattatcaaatggtaatactgctggttctgtaggttcatatgctgctgctcaaatggctgcacgtactggtgtatctgcttcaacatgggaacacatcattgctagagaatcaaatggtcaattacatgcacgtaatgcttcaggtgctgctggattattccaaactatgccaggttggggttcaactggttcagtaaatgatcaaatcaatgccgcttataaagcatataaagcacaaggtttatctgcttggggtatgt

SEQ ID NO: 241 - DNA, 921 bp, Staphylococcus epidermidis
atgaataaaaataaagtgattgtaattggatcaacaaatgtagataaatttcttaatgttaaaaggtttccaaaacccggtgagacattacatattaatcaagctcaaaaggagtttggtgggggcaagggagccaatcaagccatagcagctagtagattagcagcagatacaacatttatcagtaaagttggtaaagatggcaatgccaactttatattggaagatttcaaaaaagcaggtattcatacacaatatattttaacttcagaaagtgaagaaactgggcaagcatttatcactgttgatgaagcaggacaaaatacgattcttgtttacggtggtgcgaatatgacattaagtgcaactgatgttgagatgagtgtggatgcgtttattggtgcagactttgttgtagcgcagcttgaagttccatttgaggcgatagaacaagcatttaaaattgctcgtaaacaaaatatcactactgtattaaatcctgcaccggcaattgaattgcctaagtcacttttagagttaactgatataattattccaaacgaaacggaagcagaattattaacaggtatttcaatcaataatgaaagtgatatgaaagaaacagcaacatattttctcgatttaggtatatctgcagtattaattactttaggggagcaaggcacgtattgtgcatatcaagaacaatacaaaatgattcctgcgtgtaatgtaaaagcaatagatacgacagcagcaggagatacatttataggtgcttttttaagtgagttaaataaagatttgagcaatttagaatcggctattcgacttgcaaatcaagcgtcgtctctaacggtacaacgaaaaggagcacaagcttctataccaacacgtaaagaagtagaggcagaatataat

SEQ ID NO: 242 - DNA, 831 bp, Staphylococcus epidermidis
atggctcttaaaaaatataagccaattacaaatggtcgtcgtaatatgactactttagatttcgctgaaatcacaaaaacaacacctgaaaagtcattattacaaccgctaccgaaaagagcgggacgcaataaccaaggtaaattgactgttcgccatcatggtggtggacacaaacgtcaataccgtgttatcgattttaaacgtaacaaagatggaatcattgctaaagttgattcaattcaatatgatccaaaccgttcagcaaacattgcattgctagtttatgctgatggtgaaaaaagatatatcatcgcacctaaaggattacaagtaggtcaaactgtcgaaagtggtgctgaggcagatatcaaagttggtaatgctttaccattacaaaatattccagttgggacagtaattcataacatcgagttaaaacctggtaaaggtggacaacttgctcgttctgctggtgctagctctcaagtattaggtaaagaaggtaaatatgtattaatcagattaagatctggtgaagtacgtatgattttatctacatgtcgtgcaacaattggtcaagttggcaacttacaacatgaattagtaaatgttggtaaagcaggacgctctagatggaaaggcgttcgcccaactgtacgtggttctgtaatgaaccctaatgatcacccacacggtggtggtgaaggtcgtgctccaatcggtagaccatctccaatgtcaccatggggtaaacctacgcttggtaagaaaactcgtcgtggtaaaaaatcttctgacaaacttatcgttcgtggacgtaagaaaaaa

SEQ ID NO: 243 - DNA, 864 bp, Staphylococcus epidermidis
atgaagtcaaaattcacaattctattatttacaatcttttctacaacagtattagttttggttattatttataacaaaactcaatcccaatcatacatttcgactcactattctaataataaaataaaaacaacagcaacactttttttacatggttatggtggtagcgaacgctcagaaacgtttatggtcaaacaagcgttaaataaaaatgtaaccaatgaggtgataaccgctagagtgagtagtgaaggaaaagtatattttgataaaaaattaagtgaagatgcagcaaaccctattgtcaaagtagaatttaaagataataaaaatggaaattttaaagaaaatgcttattggattaaagaagttctatcacaactaaaaagtcaatttggaattcaacaatttaattttgtaggacattcaatggggaacatgtcatttgctttttacatgaaaaattatggggacgatcgacatttgccacaacttaaaaaggaagttaatatagcgggagtttataacgggattttgaatatgaatgagaacgtgaatgaaattatcgttgataaacaggggaaaccaagtagaatgaatgccgcatatcggcaattgttatcactgcataagatttattgtggtaaggaaatagaagttttaaatatctacggagatttagaagatggctcacattcagatggacgtgtgtcaaatagctcttctcaatcgcttcaatatttactaagaggtagcactaagtcttatcaagaaatgaaatttaaaggtgcaaaggcacaacatagtcaattacatgagaataaagatgttgcaaatgaaatcatacaattcttatgggaaact

SEQ ID NO: 244 - DNA, 795 bp, Staphylococcus epidermidis
atgaagattggaattgatgccggagggactttaattaaaattgtacaagagcatgacaatcgtagatattacagaactgaattaacaactaatatccaaaaagtcatagattggcttaacaatgaagaaatcgaaacattaaagcttacaggtggaaatgctggagtaatagcagatcaaattcatcattcccctgaaatatttgtagagttcgatgcatcatcaaaaggtttagaaattttattggatgaacaaggtcatcaaattgaacattacatttttgctaatgtaggtacaggtacttctttccactattttgatggaaaagaccagcaacgtgttggaggtgtaggtaccggaggcgggatgatacaaggtttaggctatttattgtccaatataacagattataaagaattaacgaatttagctcaaaatggagatcgtgatgccattgatttaaaagtaaaacatatttataaagatactgaaccaccaattcctggagatttaacagcagcaaattttggaaatgtattacatcacttagataatcagtttacatcagctaacaaacttgcctctgcaattggcgtcgttggtgaagttataacaactatggctattacattagcacgtgaatataagactaagcacgttgtatatatcggttcatcatttaataacaatcaattactacgtgaagttgttgaaaattacactgttctaagaggatttaaaccgtactatattgagaatggtgctttttcaggcgctttaggagcactttacctc

SEQ ID NO: 245 - DNA, 8043 bp, Staphylococcus epidermidis
atgactttaaataaccattttgcatatacatttgaggagagacctaccccaaaattatggctttgtaaaccagatggaactagaattgaaagaattgcagatttttcaaaacttggtggaacattcaaattcactaatgtgaacactttacattttgatttgccattgcaagtatttagtgaagatactaagcaaattgaaagaaataaagtagttgatttagtaaaaaataaatacttaattgattatagatataacggatatagagatatctttgtaattgatgatattaaaaaatctgctaatgactctgattttattacattaaatttagactcaagagcgtctgaattaaataagaaagctgcaaatgaaattgaattattaggttctactatccctcaaatgatgaacaaaatcttatcagtttatgctccactatggaaacttggacatgttgatggaaaaattattgatgttaaacgtgagttaactggttctaatacaactgttaacgctcttattgataatatttgttctctttttgacgcagttgctatttataacaacattaatagaacaataagcttctatcataaagacaatgttggtactaatcgtggtttaagagttagggaaaatagttatttaaaatcatttgaagatcaatttgtatcaaaggatatcgttactagattatatccatttggtcaaagtggtttaacaattcaaagtgttaacccagctggctcttcttatattgaagacttctcttatttcatgtcaccattcaaacgtgataataacagaaatgtattacaacatagtgattatatgtctgatgaattatgtcacgctttgttagattatcaagagttttatgctagtaagaaggatcaagctggtgaattatctaaacaatatagtgcaattcttaaagagcattcacaagaagacttcagattaaatcaattaagtgctacacttcaacgactaaatgagcgtgttgaattagttaaacctaaatcagaatatattgacttaggaacaaaggttaagaatttcaaaatcactgtacctaaatcatcatattatttaatcatgattagaaatgatggtagtttcactagaattaaattcaataataaacagtatgatattccaagtggtgagtggttgtatatcaaacttaaaactggtaagtttaatgacgctactaagtttgagaaacaattagaataccctcttgaaatattaagtgcaaacgctaatttaagagtggtatatactcgttcttctgaaggagattatgaagaagaagatactaagacaatcgaagaaaaatacaacttagaaaaatataaaattttagtaaaagatcaagaaaaagtagtcgcttcaatcgaaagacgattaaaagcttttgaagaccaaaaagcaagtgtaatacgttcaatgaatgcaaagaatttcttatctgaaaaactttataatgaacgtgagttatatgtttttgagtctgtttggacggaagaaaatcatacagacgctcaagaattatatgatgacgctgtaaaacaaatgaaggaacaaaagaaaatcaatagaacgattacagttgatttagttaacttcattcaatcgcttgaccataaagatgattgggataaattaaatgttggagataaagttgttttccaaaacaaaatcttcaatactaaaatcaaagcctatatcactgaaatgcaattagatttccaaactaatcaagtaaaaattactattagtgatatttttgattacaaagatttagacacaatcatcgctgaaaaattagcccaaactacctctacttcttctcaagttgatttccataaacaacaaattagagagcaaaccggaagaattacagatatgactcgtcttatcgaaggtgagtgggacgcaaataaaaagcgtgtgatggctggtaatgaaacagttgatattggttcacatggtgttaaagtcatttcaaaagagaaccctaacgaattcgtaatcatggttggtggcgtaattgctatgactcgtgataacggtgaaacatttaaaactggtattacaccagaaggtatcaatgctgaaatgcttatcggtaagatgatcgttggtgaaactttaacttttgaaaatgagtctggtacagttaaattcgacaaagatggactttatgttaactctaaaaacttccatttagtttcaaatgatggagaagaagactacttcgataaattaaaacgtgaaatgtctgaaaacgctaaacaacaaacagacagaatgttagaagagtataaaaaagaagtttcacaaactatttctgaagctactgacgttagaaacattgttgataatgcagcagatattcttcaagcagcttttgctgatggagttatcacagatgttgaaaaacgtttgatttctgaaactcttgctcaacttgaaaaagaaaatagagaattcgaagataaaattaacttagctttaaaccacccttacatcactgaggaagatactattgagttaaataattctatcgttgaatatagctcaatgtatgaaacacttgttatttctattaatgaaagtgttagtgacaagatgatcacacctcaagagtctgaagaaattaatcaaaatattataaacttcagagaagagatcaaagacatcttatcattagtagaagaaattattgaacgaactaaaaatgctcaactacaagctactttagaagaagcaaaagattatacaacaagagttcgtgacgatattaaagatgaattaaaagacttaaataattcatttaaatctttaaatagtacagttgaagagtcattacaagataatatttttgacgctgctgaattagaagctattaaaacagttgtattagtaactaaatcagaatatcaagatattacaaatagatattcttcaatgtctgcaaatacagatttaaaatcggaaagtaaattagatttaacaaaatcttataaaactttagatactagctttaatgactttgttaaatatattgacgaaatgacaatggatagaattgcagatgagactgagaaagttaattacaaaaagaaatatgatactttacaaaagaacttatcagattatatgaaaaaatatgataactgtattttggaaatatctaaaaagtattctaatgacgcagcagataaagtgttaggtgacttcacagctattgctactgaattacaaaatgatttccaagatgttaaagacaattgggctgaattcaagcaaactactcttgagtcatttaaagatggtatagtaactgaggcagaaaaagctcgactaagagtacaattagatatgcttgatcgtgaaagcatggatattgaagaacgatataaaagcttacttgctaaccaatatactaatactgatattaaaaatcgcttaactgcttcacgttctccttacttatcagttcatgctagtttaagaaaagtaattgaacaaataattgctgacggaaaagttgatgaaagtgaaaaaacattagctaataattcacttaatacatacaacacaacattaactgcttattctaaaacaattcaagaagctctaaatacattatcacaaatcatctcttctgatgtagcaagtaaaaaagttgaagaattcaatggtgtaataactacaatttcttcagacgttgatacaatcaagaaacaaagagatggtgcagtaatcacttattattatagcggtgtacctacattatctaacgatccagctaaaagttggacgactaatgatttaaaagacttacatattaaagatatgtatttagacactaaatctggttatgcatatactttcactaaatctggtactagttattcttggaaaccacttactgaccaagttattgttagctcattgaaacaagcaaaaaatgcacaagacacagcggacaataaacgtagagtttttgtaactcaacctattcctccttatgatcaaggagatatgtggactcaaggttcacaaggagatatttatgtctgtggaacttcgagagctactggctcattcgtaagtagcgactgggttaaagcgagcaaatacactgacgatacagtagctaaacaggcagcaaaagatttagaagattataaagtcaaaatgactaaagacttcaaagatttaaatgacggtgtatctacttttaaaactgaagtggttaaagatttcaaagatggaattgtaactgaagctgagaaaactagattacgtgttcaattagatatcttagatagagaaagtcaagatatcgaagaaagatataatagtatctttaacagtcaatatgcagatactcaagttaaaacttctatttctaacgcacgctctacttataataactctcttactaagttaagaaacactattcaaaccgtgattgaagatggaaaagtaacgcctactgagaaaactactgctaatcaaactttaaccgcatataataatgctttaacgagttattcagctgctatccaagaagcattaaatagcatgtcaaaagtaattgctcaaaaagaagctactagtcaagtaaatcaattcaatgaagttatcaaaaatataaatacaaatattactgatattcaaaaacaagttgatggtgcaattgaaactttctattacagtggagtaccaacacttactaatatccccgcttcgtattggacaactgctagtaaacgtgaagctcatttaggtgatttatatttagacactgctactggtgttgcttatcgtttcttaaaaaaaggaacaacttcccctacttactattggtctccaatttctgatcaaattattacagacgcattgaatagagcaaaaacagctcaagacaccgccgatggaaaaagaagagtttttgtaaatacacctgttccaccatacgacactggtgacatgtggacgcaaggagctagtggtgacatcttagtttgtaaaacacctaaagctaaaggtggtatttactcaataagcgactgggtaaaagctagtaagtatacagatgatacagtagcaaacagtgctgttcaacaattaaatgaatacaaacgcactaataatcttgatatcgcagacctaaagagaaaaactagtgacttcgaaaaaacagttgtaaatgcatttgacgatagagtcattagtatttccgagtcttcatctattaaaggacaacttgctctacttaatcacgaaaaagatagattaactagacaatacgaaaatataatcagaaattctaatcttgttggagcagaaaaaactaaattatctactgcatattcaaatataaatactaagcttagtgatttaagtacaactattaatagtgcaattgttgataataaaattgttgacgctgaaagtaaatctgtaacttcaaaatttgaattgtataaagcttcagttaatgaatatcaaatcgcttttgataatgctctaaactcaattattagagaaatcgcttcttcccaagctaaagatagattagatgaatggaaacgtacagaatttagtacagactcagacggtattattgaaagagtagctggtgctaagtttgactcaaaatggactgatacttggagaaatacagttaacccagctattcaacaagtgagtaatataacatatggaagtgaaaacctattacttaatagcgaaagtcgaagtgacggtgctaataccacgactcactcttttataagatactacctgacacgccctttagaaacagggaaaacttatactttaaaagctagtgttttaacaactgatgaaagacaaagtggacaaattagtgtttatccatactcccctaacggagcaagagagacagtaaatattaaagacggtaaaattacttatacatttactgcacaaactgaaagtacacaatttcttatttataaagacgtggctggtcaatctgatgtagacttaaatgtaacaatcgagaaggctattttagtcgaaggaaataaagttacagggtggtctccagcaccagaggagacttcttctgctttacgagattataatactcgtatctcctcagcagaaacattcattgagaaaaacaaagaaaagatttctcaaattgctactaaatctgatgttgacgcttcacttagtaaagtagctacttatgaaactcaatataatgtttctagcggaactaactatcaaattcctcttcaagaatacaatggttcattctttaccgacaactacacttatgaagttgtagctaaaaataactctttaagttctaacaacgtagcaactgctatattcgtaagtaaaggttcaaacaatggttatgaattggttgaattagacaacatgtctaaaactggtgctaaccctagatttgttttagacagtaaaggtagaccttctatctctactttctcccctcaatctactactcaagatatttcagttatttacactaaatatttaggtagtgcttcagcaatcaatacaactaaatcattgattgagcaaactgctagttctattgaattacaagttaagaaacttactgctgagactgaatacaacaacatattattaaattcagacttctcttctggctgggaaggttggataaatgttgatcctcagtatagtattgttgataaaaatacttttggtatcactcttcctgacgcaatcactaataaaaataagaaatataatacagttaaaatgacatacaataaaaatacaaattacccttctgtattttctaattttatttctgttggaaaaggtcaagaggtagctattggtgaacatttaacactaacttgttatgcctatatcccttcttcatctaaaggtaaattaactggtaacatatatattgaattcgctggttactatgaaaaagaccaaaaatcaaacccaatgattgctagacatgaaatattacctaaagattttgaatataataaatggttcagaatgacagctagtactgctattccttctactaactctgagggtaaaaaaatcaattatattagagcttgtttacgttatgacggtaaaaatcaaagcgtaaataatagtgctatattctattatgcgttacctcaattagagcgtggatcaaaaccaaccgagtggtcgttatcaagacttgacgtatttagcactgaacaattggcagctaagattgccttaaacccagagagtgtggatattatcgcaagaaatattgatttcaatactgactcaatgaagatttataattctaacggtacattaaacatttctggagatactttaacaattagtaacaacaatagttctaatgaagtaattataaatccaaaaggttttacacttaaaaaagatggtgtagttaagtttaaaaatggactagacacaagcgattatagtgtccaagcttatgaaccacagtttagttcatggaataatattaaagctactgatcccgctgctaagagtaagtataattacattcgacatattgagccggggatgaatggttattacactataaatactggtgtttacaattttgcagtacaacacaaacaactattagaggtaaataatacaaaaaatgcgagagttaacaggtatacatatctttacaacaaaaggtatttaaaaatacaaatgtctgcttcttctcgaggtaaaagtaagctttatataatattcaagacaaaaactggagatactacactccatcaagaaatagttagttctagttcaatggtatacccagatataacaattgacttacaggctaaattaggttatccgcctaacaatttgccagacttttttgaattacaagctggtattgcctatggagaaaataattctattgatggtttctttagaattagacgtatggcaatgacagatacaccaaatgcggaggtt

SEQ ID NO: 246 - DNA, 1248 bp, Staphylococcus epidermidis
atgtataacgtgacacagcatgcgacttataaaacaaaaaataaacgagaaactgctgtattaatcggtgtacatgctcaaacggatcgtcaatttaattttgaatctactatggaagagctcgatgctttatcacaaacttgccaacttaatgttaaaggacaaatcactcaaaatagagagcaatttgaccataaatattatgttggaaaaggaaaaatcgatgaaataaaatctttcatagaattccatgatatagatgttgtcgtaaccaacgatgaattaacgacggcacagtctaaaacgttaaatgataatttgggcattaaaatcatcgatagaacccaattaattttagagatattcgcgttgcgagcgagaagtagagagggaaagctacaagtagaacttgcacaactcgattatttgttaccaagactacatggtcatggtaaaagcctgtctcgtcttggtggtggcataggaacaagaggcccaggtgaaacaaaattagaaatggatcgtcgccatattagaacacgtatgaatgagattaaacatcaattaaaaacggtcgtggatcatcgggaaagatatagaaataaacgtgaacaaaatcaagtttttcaaatcgctttagttggttatacaaatgcaggaaaatcgtcatggtttaatgttttagctaatgaggagacctatgaaaaaaatattttgtttgcaacattagatcccaaaacacgacaaatacaagtgaatgaaggatttaatttaattatttctgatacggtaggatttattcagaaattaccaacgacattggtggctgcgtttaaatctacactagaagaagctaaaggtgcagacgtacttatgcatgtcgtcgatgcaagtcattcggaataccgtactcaaattgacactgtaaatcaaattattaatgatttagatatggaccatattccacaagtagttatttttaataaaaaagacttatgtaacgaacagatggatgtacctgtatctaaatctgcgcatgtttttgtatctagtcgtgatgaaaatgataaacaaaaggtgaaaaatttagtaattcaagaaataaaaaatagtctcagcccatacgaagaaattgtagatagtgctgatgcagatagattatattttcttaaacaacacacgcttgttactgaattaatatttgacgaaacacaagcatcttatcgtatcaaaggatttaaaaaatta

SEQ ID NO: 247 - DNA, 606 bp, Staphylococcus epidermidis
atgatgatcatcgtcatgttaatcttgagttatctgattggtgcattcccaagcgggttaattattggtaaattattttttaaaaaagatataagacaatacggtagtggaaatactggagcaactaacagttttcgtgttcttggaagaccagctggatttatagttacgtttttagatattttcaagggatttattacagtcttttttccactatggttcccagttcatgcggatggtgttataagcaccttctttacaaatggtttaatagtaggattgtttgcaatactcggtcacgtgtatccaatatatctgaaatttaatggcggaaaagcagtagctaccagtgcaggagttgtattaggtgtcaatcctattttacttcttatcttggcaattatcttttttagtgtattaaaaatctttaaatatgtttctttatcaagtatcattgcagcaattagttgtgtgattggttcaatcatcattcatgattatattttacttgctgttagcggaattgtttcaatcatattaataattcgacacaaatctaatatagttagaatttttaaaggagaagaacctaaaattaaatggatg

SEQ ID NO: 248 - DNA, 1671 bp, Staphylococcus epidermidis
atgatgaatcatagtgaagctttaactgaacaagtattttcatttgcttcagagctttatgcttatggtgtaagagaagtagtaattagtccaggttcacgttcaacaccattagcacttgttttcgaagcacatccaaatattaaaacatggattcaccctgatgagcgaagtgctgcattttttgctttaggtcttattaaaggtagcgaaaaacctgtagcaattctttgtacatctggaacagccgctgcgaactacacacccgctatagctgaaagtcaaattagtcgtttgcctctcgttgttttaacgagcgacagaccgcatgaactgcgcagtgtgggtgcacctcaagcaatcaatcaggtaaatatgtttagtaattatgtgaactttcaatttgatttgccgattgctgatggaagtgaacatacaattgatacaattaattatcaaatgcaaattgcaagtcaatatttatatggaccacaccgaggaccgattcattttaatttaccatttagagaaccactaacaccagatttagatcgtgtcgatttattaacatctgtaactaaaacgttacctcattatcagaaatcgatttcggtagatgatataaaagacatattacaagaaaaaaatggtctcatcattgtcggagatatgcaacaccaagctgttgatcaaatattaacgtattcaactatatatgatctgccaatcttagcagatccccttagtcagcttcgtaaagagaaacatcctaatgttataaccacttatgatttattgtatcgagcaggattaaatttagaagtagactatgtcatacgtgtaggtaagccagttatttctaaaaaattaaatcaatggttgaagaaaaccgatgcgtatcaaattattgtgcagaataatgatcaaattgatgtatttccgacaccacctcatatatcttatgagatttcagcaaatgattttttccgttcattaatggaagaaccacttgttgaacgaaaaaaatggttacagcaatggcaatcacttgaacaacaagcacgcattgaaataagtgattacttaaagcatgcgacagatgaagcggcatatgtagggagtttaattcaaaaacttacaaaagaagatacattatttgttggaaatagtatgccaattagagatgtcgataatttactgtttgatagtgaggcatctgtatacgctaatcggggtgccaatggaatagacggagtagtttcaactgcgctaggtatggcggcacataagaatgtgacattgcttattggtgatttatctttttatcatgacatgaacggtttattaatggccaaattaaatgaacttcatattaacattgtattagttaataacaacggaggaggtatcttttcatatttacctcaaaaacgatcggctacaaaatattttgagcgattatttggaacaccaacaggcttaaactttgaatatactgcactgttatatgattttacatttaagcgctttgataatttgactgactttaaatatgctgaattatctaaaatgggttctcacatgtatgaagttataaccaatagagacgaaaatttgcatcaacaccaaaatttatatcagaaattgagtgagattgttaatgttacatta

SEQ ID NO: 249 - DNA, 4005 bp, Staphylococcus epidermidis
atggcgaaaaaattcaattacaaattaccgtctatggttgctttaacgttatttggcacagcttttactgcacatcaagcaaatgctgctgaacaaccacagaatcagtctaatcataaaaatgtattagatgatcaaactgccctcaaacaagcagaaaaagctaaaagcgaagttacacaatcaactacaaatgtatctggtacacaaacatatcaagaccctacccaagttcaacctaaacaagacacacaaagtactacatatgatgcatcattagatgaaatgagtacttataatgaaatttcatcaaatcaaaagcaacaatctttatcaacagatgatgcgaatcaaaatcaaacgaattctgttacaaaaaatcaacaagaagaaacaaatgatttgacacaagaagataaaacatccactgatacaaatcaattacaggagacacaatctgtagcaaaagaaaatgagaaagatttaggagctaacgcaaataatgaacaacaagacaagaagatgactgcaagtcaaccttccgaaaatcaagcaattgaaactcaaactgcttctaatgataatgaaagccaacaaaaaagtcagcaagtaacttctgaacaaaatgaaactgctacacctaaagtatcaaatacaaacgcatctggttataattttgattacgatgatgaagacgatgatagctcaacagaccatttagagcctatctcattaaacaatgtgaatgctacatctaaacaaactacttcatataaatataaagaaccagctcaacgtgtaacaactaatactgtaaaaaaagaaacggcatctaatcaagcgactatagatacaaagcaattcaccccatttagtgcaactgctcaaccgagaacagtttattctgtatctagtcaaaaaacatcatcattaccgaaatatacaccaaaggttaattcttcaataaataactatattcgtaaaaagaatatgaaagcaccaagaattgaagaagattatacgtcatatttccctaaatatggctatagaaacggtgtgggacgtcctgaaggtatcgttgttcatgatactgcaaatgataactcaacaatcgatggcgagattgctttcatgaaacgtaattacacaaatgcattcgtacacgcatttgttgatggcaatagaattatagaaacagctccgacagattacttatcttggggtgcaggtccatatggaaatcaacgttttatcaatgttgaaatcgtccatacacatgattatgattcatttgcacgttcaatgaacaactacgctgattatgctgcaacgcaattgcaatattataatttaaaacctgatagcgctgaaaacgatggaagaggaacagtttggacacatgctgctatctctaacttcttaggaggtactgatcacgctgaccctcaccaatatttaagaagtcacaattatagctatgcagaattatatgacttaatttatgaaaaatatttaattaaaacgaagcaagtagcaccttggggcacaacatctacaaaaccgtcacaaccttctaaaccatcaggaggaactaataataagttaactgtgtctgctaatcgtggtgttgctcaaattaaaccaacaaataatggcttatatacaactgtttatgacagtaaaggtcataagactgatcaagtacaaaaaactctatccgttactaaaactgcaacattaggaaataacaaattctatttagttgaagactacaatagcggtaaaaaatacggttgggttaaacaaggtgatgttgtttataacactgctaaggcaccagtaaaagtgaatcaaacatataatgttaaagcagggtcaacactttacacagttccttggggtacaccaaaacaagttgctagcaaagtatctggtactggaaatcaaacatttaaagcaactaaacagcaacaaattgataaagcaacgtatctttatggtacagtgaatggtaaatctggttggattagtaaatattacttaactacagcatctaaacctagcaatccaactaaaccttcaacaaacaaccaattaacagtgactaacaatagtggtgttgctcaaatcaatgcaaaaaatagtggcttatatactacagtttatgacactaaaggaaagacaacaaatcaaatccaacgtacattgtcagtgacgaaagctgccacacttggtgataaaaaattctatcttgttggtgattataatactggtacaaattatggttgggtaaaacaagatgaggtcatttacaacacagctaaatcacctgtaaaaatcaatcaaacatacaacgtcaaacctggtgttaaattacacacagtaccttggggcacatataatcaagtggctggaacagtttcaggtaaaggcgatcaaacttttaaagcaactaaacaacaacaaattgataaagcaacatatctttatggtacagtgaacggtaaatctggttggattagtaaatactatttaactgcaccatcaaaagttcaagctttgtctactcaatcaacaccagcacctaaacaagtaaaaccatctacacaaactgtaaatcaaattgctcaagtgaaagctaataattctggaataagagcatctgtatatgataaaacagccaaaagtggtacgaaatacgctaaccgtacattccttatcaataaacaacgtactcaaggtaataacacgtatgtactacttcaagatggaacaagtaatactccattaggatgggtaaacattaatgatgtgacaactcaaaatatcggaaaacaaactcagtctataggtaaatattcagtaaaacctacaaataatggtctatattctattgcttggggtactaaaaaccaacaattactagcacctaatacgctagctaatcaagcatttaatgcttccaaagctgtttacgttggtaaagatttatatctatacggtacagtcaataacagaacaggatggattgctgctaaggatttaatccaaaacagtactgacgctcaatcaacaccatataactatacttttgttatcaataatagtaaaagttatttctatatggatccaacaaaagcaaaccgatattctttaaaaccatattatgaacaaactttcacagtcattaagcaaaaaaatattaatggcgttaaatggtactatggtcaacttttagacggtaaatatgtttggataaaatcaactgacttagttaaggaaaaaattaaatatgcatatactggaatgactttaaataacgcgataaatatccaatctcgtcttaaatataaaccacaagtacaaaatgagcctttgaaatggtcaaatgctaattatagtcaaattaaaaatgctatggatacaaagcgtttagctaatgattcatccttaaaatatcaattcttacgtttagatcaaccacaatacttgtcagcacaagctctcaataaattattaaaaggcaaaggtgtacttgaaaaccaaggcgctgcatttagccaagctgcacgtaagtatggtctaaatgaaatttatcttatctcacatgctttagtagaaacaggtaatggaacttcacaacttgctaaaggtggagatgtttcaaaaggtaaattcacaactaaaacaggtcacaaataccataatgtctttggaattggtgcatttgacaataatgcacttgtagatggtatcaaatacgctaaaaatgctggatggacttctgtctctaaagcaattattggtggcgctaaattcattggaaattcatacgtgaaagcaggacaaaatacgctatataaaatgcgttggaatcctgcaaaccctggtacgcatcaatatgcaactgatattaattgggcaaatgtcaacgcacaagtattaaaacaattttatgataaaattggtgaagtcggtaagtacttcgaaattccaacatacaaa

SEQ ID NO: 250 - DNA, 1299 bp, Staphylococcus epidermidis
gtggcatttgaatttagattacccgatatcggggaaggtatccacgaaggtgaaattgttaaatggtttattaaagccggcgatacaattgaagaagatgatgtattagcagaagttcaaaatgataaatctgtagtagaaattccttctccagtaagtggtactgttgaagaagtgttagtagatgaaggaacagtggcagtagtaggagatgtcatcgttaaaattgatgcacctgatgcagaagaaatgcaatttaaaggtcatggcgatgatgaggattctaagaaagaagaaaaagaacaagaatcaccagtgcaagaagaagcttcatcaactcaatcacaagaaaagacagaagtagatgaaagtaaaactgttaaagcgatgccgtcagtgcgtaagtatgcacgtgaaaatggtgtcaatattaaagctgtaaatggttctggtaaaaatggacgaatcacaaaagaagacatcgatgcatacttaaatggtggtagttccgaagaaggttcaaacactagcgcagcatctgaatcaacttctagtgatgtcgttaatgcttctgcaacacaagcattaccagaaggcgacttccctgaaactacagaaaaaatacctgcaatgcgcaaagcaattgctaaagcaatggttaattctaaacacactgcacctcatgttacattaatggatgaaattgatgtgcaagaattatgggatcaccgtaagaaatttaaagaaattgctgctgaacaaggtacaaaacttactttcttaccatatgttgttaaagcattagtttctgcacttaaaaaatatccagcacttaatacttctttcaatgaagaagctggagaggttgtacacaaacattactggaatattggtattgctgcagatacggataaaggattattagtaccagtagttaaacatgccgatcgtaaatcaatattcgaaatttctgatgaaattaatgaactagctgtaaaagcacgtgatggtaaattaacttcagaagaaatgaaaggtgcaacatgcacaattagtaatatcggttccgctggtggacaatggttcactccagttatcaatcacccagaagtagctatcttaggaattggccgtatcgctcaaaaacctatcgttaaagatggagaaattgtagctgcaccagtgttagctttatcattaagctttgaccatagacaaatcgatggtgctactggacaaaatgctatgaatcacattaaacgcttattaaataatccagaattattattaatggagggg

SEQ ID NO: 251 - DNA, 2208 bp, Staphylococcus epidermidis
atgaatgaaacagacgaaatttcacaaatctataacaagcatcgattaccaagtttaagtggtctagcaaaagtgtctccacttgttcatagggccagcataggaggcgttttaaatgtggcagaattaaacagaattaaacgcctagttcaagtgcaaaatcaatttaaaacattttacaatcaaatgctagaagaagatgaagaggttaagtatcctatactgcatgataaaatgaatcatctaccgatacttacagatttatttaaagaaattaatgaaacatgtgatgcacacgatttatttgaccatgcaagttatactttacaaagtattagaagtaaaatttcaagaacaaaccaacgaattcgtcaaaatttagatagaatagtgaaaaatcaagggaatcaaaaaaaactatctgatgcaattgtaacagtaagaaatgatcgcaatgttattccggtgaaagctgaatatagacaagatttcaatggtattgttcatgatcaatcggcatcaggacaaacactatatattgaaccgaattctgttgtagagatgaataatcaaatcagtcgtttgcgtaatgatgaagcagttgaacgtgaacgtatattgactgaattgacgggatttgtttcggcggaagctgacgcattactcattgctgaatcggttatgggtcaaattgattttttaattgctaaagctcgttatgcgcgcactataaaagggacaaaacctacatttaaagaggatcgaactatatatttacctaatgcatttcaccctttattagacaaagatactgttgtagcaaatacaattgaatttattgacgatgtagaaacagtcataattactggaccaaacacgggtggtaagacggttactttaaaaacactaggattgataattgtcatggcacaatcaggattgttaattcctacactggatggaagtcaattaagtatctttgaaaatgtatattgtgatattggagatgaacaatctatagaacaatcattatcaacattttcatctcacatgaaaaatatagtagaaatattacaagatgcagatcaaaatagtctcattttatttgatgaactaggcgcaggtacagatccaagtgaaggtgcggcactcgcaatgagtatcttagattatgtacgccgtttagggtctttagttatggcaacaacacattaccctgaattaaaagcttatagttataatcgtgaaggtgtcatgaatgcaagcgttgaatttgacgttgaaacactgagcccgacttataaattattaatgggtgttccagggagatctaatgcctttgatatatcgaaaaaacttggtctaagtctcaacatcattaataaagctaagacaatgatagggacagacgagcaagagatcaatgccatgattgaatcattagaacaaaattcaaaacgtgttgatcaacaacgtatagaattagatcgacttgtgagggaagcacagcaaacccacgatgctttgtctaaacaataccaacagtatcaaaattatgagacatcattgatggatgaagctaaagaaaaagctaatcagcgtgtgaaatctgcgactaaagaagcggacgaaattcttaaagaacttagaaatctaagagatcataagggcgctgaggtaaaagaacatgaattaattgataaaaagaaacaacttgatgatcaatatgaggtaaaatcaattaagcaacatgttcaaaagaaaaagtatgatacgattcatactggagatgaagtgaaagttctatcttacggtcaaaaaggtgaagtgcttgaacttgtaggtgacgaagaagcagttgtacaaatgggaatcattaaaatgaaattacctattgaagatttagaaaaaacgaaaaagaaaaaagaaaaacctacaaaaatggtaacaagacaaaatagacaaactattaaaacagaactagatttaagaggatatcgttacgaagaagctttaaatgaattagatcaatatcttgatcaggcggttttaagcaattacgaacaagtttatattattcatggtaaaggtacgggggcacttcaaaaaggtgttcaacaacatttgaaaaaacataaaagcgttagacaatttaggggaggtatgcctagtgaaggtggatttggtgtcactgtggcagaactcaag

SEQ ID NO: 252 - DNA, 1224 bp, Staphylococcus epidermidis
atgagtttttttaaacgtctgaaagataaattttctagtaaaaatgaagatgatattcaaaaagacctggatgaatctgtagattcaaatgttaacagtgattcagattcaatggatccgaatgattctgatgaacaagttaaacccaaaaagaaacctaaaaaattaagtgaagctgattttgacgaagatggcttgatatcgattgaagattttgaagaaatagaagctcaaaaaattggagcaaaattcaaggccggtttggaaaaatcacgtcaaaacttccaagaacagttaaataatttaattgctcgatatagaaaagttgacgaagatttcttcgaagctctggaagaaatgcttattactgcggacgttggttttaatactgttatgaaattaactgatgagctacgtacagaagcacaaagacgtaatatacaagaaacagaagacttaagagaggttatagttgagaagattgtagaaatctatcatcaagaggacgatcattctgaagcaatgaatattgaagatggacgtttaaatgtcatactgatggttggtgtgaatggtgtcggcaaaacaacaacaattggtaaattagcttatcgttatcaacaagaaggtaaaaaagtaatgttagctgctggtgatacttttagagctggagcaattcaacaattaaacgtctggggagaacgtgttggcgttgaagttgtgagtcaaaacgaaggttctgaccctgcagcagtagtatatgatgcgattaatgcagcaaaaaataaagacgtagatattttaatttgtgacactgcaggacgcttgcaaaataaatctaatttaatgcaagagttagataaaatgaaacgtgtgattaatcgagcaatacctgatgccccccatgaagctttattatgcttagatgcaacaactggtcaaaatgcactttcacaagcacgttcatttaaggaagttacaaatgtctcaggtatagttttaactaaattagacggtactgctaaagggggtattgtattagcaattcgaaatgagttacacattccagttaaatatgttggtttaggtgaaaaaatggatgacttacaaccgtttagtcctgaaagctatgtatatggattatttgctgatatgatagaacaaaatgaagatattcctgaagaaatctctagaaattcatccgttgaatctgaagaaggtaac

SEQ ID NO: 253 - DNA, 1653 bp, Staphylococcus epidermidis
atgaaaagaaattggtggaaagaagcagttgcatatcaagtatatccacgaagttttaatgatagtaatggagatggaataggtgatctacctggattaattgaaaaattagattatctagaaaatttaggaatagatgtcatttggttaagcccaatgtatccatcaccaaacgatgataatggatatgatattagtgactacaaaggcattatgagtgaatttggtacaatgaacgattttgatcaattgttatcaagcatacatcaaagagggatgaaattaatattagacttagtggttaatcacacatcagatgaacacccttggtttattgaatcaaaatctagtaaaacaaatgcaaaaagagattggtatatttgggcagatcctaaaccggatggatctgaacctaataactgggaaagtatctttaatggttcaacttgggagtttgacgaatcgactaagcaatactatttccatttatttagcaaaaagcagccagatttaaattgggaaaatccagatgtaagacaagctgtgtttgaaatgatgaattggtggtttgaaaaaggtattgacggatttagagttgatgccattactcatattaaaaagaattttgaagcaggagatttacctgtacctgatggcaaaaaatttgctccagcatttgatgtagatatgaatcagccaggaatacaagaatggctccaagaaatgaaagataaatcgttaagtcggtatgacattatgactgtaggcgaggctaatggtgttactcctaatgatgctgaagaatgggtaggagaagaaaatgggaaatttaatatgatattccagtttgaacatcttggtttatggagtactggcgatacgaaattcgatgttaaatcctataaacaagtcttaaatcgttggcaaaagcaactagaaaatgtaggttggaatgctttatttatcgaaaaccatgatcaaccacgtcgtgtttcaacctggggtgatgataaaaattattggtatgaatcagcaactagtcacgctactgcctactttttacaacagggcacaccttttatttaccaaggtcaagaaataggtatgactaattatccatttgaaagcattgaaagtttcaacgatgtcgcagtgaaaactgaatatcaaatagtcaaaaaagaaggtggagatgtcaatcaattactagataaatataaaatggaaaaccgagacaatgcaaggactccaatgcaatggaataattctatcaatgctggattcactactggtaagccatggtttcatgtaaaccctaactatacagaaattaatgttaaacaacaactaaatgataagttttcgatactttcttattataaagcgttaattcaactaaaaaaatctgatttgatttacacctacggtaagtttaatatggtcgatgctgaaaataagcaggtttttgcatatacacgcacatttaaaaacaatactgtattaattgtagccaatctcacaaatgaagtatcagaactaaacctaccttttgaattagatatttcatctgtagatataaaattgcataattatcacttaaatgatataaatttagaccatattaaaccttatgaatcattcgtcgttgaaata

SEQ ID NO: 254 - DNA, 1422 bp, Staphylococcus epidermidis
ttgagtcatagaaagctatttccttctatattccatttatatcaacaagacaatttagatgaacatattgctattattggtataggacgtcgcgattataataacgaacaatttcgcgaccaagttaaagcgtcaattcaaacttatgttaaagatacagatagaattgatgagtttatgacgcatgttttttatcataaaactgacgtgagtgataaagaaagttatcagtcattacttcaatttagtgagcgactagattcagaatttgctttaggtgggaatcgtctgttttacttagcgatggcaccacaattttttggagtgatctcagattaccttaaatcttctggtcttactcaaactacaggatttaaacgcttagttatagagaaaccatttggcagtgatcttaaatctgctgaatcattaaataatcaaataagacgttcgtttaaagaagaagaaatttatcggatagatcactatcttggcaaagatatggtgcaaaatatagaagttttgcgattcgcaaacgcgatgtttgaacctttatggaataataaatacatttcaaatattcaagttacatcatcagaagtattaggtgtcgaagatcgtggtggctactatgaatctagtggtgcacttaaagacatggtacaaaatcacatgctacagatggttgctttacttgcaatggaagcaccgataagtttgaatagtgaagatatacgtgcagaaaaagtcaaagtacttaaatctcttagacaattaaaaccagaagaagttaaaaagaatttcgtgcgtggtcaatatgatcaaggcaatatagatggtaaacaggttaagtcatatcgagaagaagatcgcgtagcaaaggattcggttacaccgacatttgtatcgggtaaattaacaattgataactttagatgggctggagttcctttctacattagaacgggtaaacgtatgaaatcaaaaacgatacaagtcgtagtagaatttaaagaagtacctatgaatttatattatgaaactgacaatttactagattctaatttgctagtcattaatattcaaccaaatgaaggaatttcattgcatttaaatgctaaaaagaacattcaaggaattgatactgagccagtgcaattatcatacgcaatgagtgctcaagataaaatgaatacagttgatgcatatgaaaacttattgtttgattgtcttaaaggtgatgcgactaattttacacattgggaagaattaaaatctacttggaaatttgtagatgcaatccaagatcaatggacaatggttgaaccatgtttccctaactatgaagcgggtacgaatggacctcttgaaagtgatcttttattaagtcgtgatggaaatcattggtgggatgatatccac

SEQ ID NO: 255 - DNA, 427 bp, Staphylococcus epidermidis
atgattaaaaaaaacaaagaagaactgaatgacatggagtatctagtcactcaagaaaatggtactgaacctccgtttcaaaacgagtattggaatcactttgaaaaaggaatttacgttgataaattgtccggcaaaccattatttacttcagaggataaatttgaatctaattgcggttggccaagtttctccaaagcattaaatgatgatgaaatcgtagaacttgttgataaatcatttggtatgattagaactgaagttcgatcagaaaaagcaaatagtcacttggggcatgtttttaatgacggacctaaagaaaaaggtggtttaagatactgtattaactctgctgcgattcagtttataccttatgataaactagaagagttaggatatggagatttaattaaacattttaaaaaat

SEQ ID NO: 256 - DNA, 801 bp, Staphylococcus epidermidis
ttgaaaaagttagcctttgcaattacagccgcttcaggcgcagcagcagttctatcacatcatgatgctgaagcttctacacaacataaggttcaatctggagaatccttatggactattgcacaacaatacaatacttcagtagaaagcattaagcagaataataatcttagcaacaatatggtattcccaggacaagttattaatgtaggtggaagtgcttcacaaaatactagttcaaacacttcttcaagttcagcatcttcacatactgtagtagcaggtgaatcattaaacatcatagctaataaatatggtgtttcagttgatgcattaatgcaagcaaatcatctaaatggttatttaattatgcctaaccaaatattaactatccctaatggtggttctggttcaggatcaggtggtacagcaactcaaactagcggtaattatacttcaccttcattcaaccatcaaaacttatacactgaaggtcaatgcacatggtatgtgttcgacaaacgttcacaagctggtaaacctatcagtacttactggtctgatgcaaaatactgggcgtcaaatgcagcgaatgatggttatcaagttgataatactccatctgttggtgcaattatgcaaagtacacctggaccatatggtcatgtagcatacgttgaacgtattaatggtgatggtagtattttaatttcagaaatgaattatgcaaatggtccatacaatatgaactatcgtactatcccagcttcagaagtatcttcatatgcatttatccactaa

SEQ ID NO: 257 - DNA, 648 bp, Staphylococcus epidermidis
atggcacgtattgctacaaaattgggctatcctgaaagcaatagtttcgtgactaatactgtaattgaatttgttttacataacgaagcatatcctcggttatataggattaaaactcgagatacgaacttaataaaaatttctcaagctaatgaaatctcacgtcaaattacaaatggcacgatgacgcttgaagaagctaagtatcaattagaggaaatatatgttgctaaaagagatagcagtctacccttcaaaggaattgccgcagcaattatcgctacgagcttcctctatctacagggaggtcgtctggttgatatcatcacagctgtattagctggaacgattggatacttagtagtagaaatattagatcgaaagctacacgcacaatttattccagaatttataggttctttggtaataggtattatttctgtaattggacatgcatttgttcctagcggagatttagctacaattatcattgccgcggtcatgcctattgtacctggagtacttattacaaatgctattcaagatttattcggaggacatatgttaatgtttacaacaaaatctttagaagctttagttactgcctttggtataggcgctggtgtaagttcaatattaattttagtc

SEQ ID NO: 258 - DNA, 876 bp, Staphylococcus epidermidis
atgacagaatttgacttatccactagagagggtcgttggaaacatttcggttctgttgaccctgtcaaaggtacgaaaccaactactaaaaatgaaatgaccgatttacaaagcactcacaaaaatttcttatttgaaatagaggaagtaggcattaaaaatttaacttatccagttttaattgatcagtatcaaacagctggtttatttagtttttcaacgagtttaaataaaaatgaaaaaggcattaatatgagtcgcatattagaaagcgttgaaaaacattatgataatggcattgaacttgaatttaacacactacatcaattgttgcgtacgctacaagataagatgaatcaaaatgctgcaggtgttgatgtgtcaggtaaatggttctttgatcgttatagtcctgttacacatattaaagctgtaggtcatgcagatgttacttatggtttagctattgaaaatcataccgttacacgtaaagaattaactattcaagccaaagtaacaacactatgtccttgctcaaaagaaattagtgaatattctgcacataatcaacgtggtatcgttacagttaaagcatatttagataaaaataatgacgtcatcgatgattataaaaataaaattttagacgctatggaagccaacgctagttctatcttatatccaatcttaaaacgtcctgatgaaaaacgagtaacagaacgtgcttatgaaaacccacgatttgttgaagatttaattcgactaattgcagcagacttagttgaatttgattggattgaagggttcgatattgaatgtcgtaatgaagagtctatccaccagcatgatgctttcgcacgtctgaaatatcgcaaa

SEQ ID NO: 259 - DNA, 973 bp, Staphylococcus epidermidis
gtgcaaaaaaaatatattactgccattattggaacaactgcccttagcgcattggcatcaactcatgcacaagctgcaacaacgcatacagtaaaaagtggagaatctgtatggtcaatttctcacaaatatgggattagtattgctaaattaaaatcacttaatggattgacttccaatttaatattccctaatcaagtattgaaagtatcaggctcatcttcaagagcaacgtcaacaaatagtggcacagtttatacagttaaagctggagattcattatcttctattgctgcaaaatacggtacaacttatcaaaaaatcatgcaacttaatgggttaaataactatcttattttccctggacaaaagttgaaagtttctggtaaagcgacgagttccagtcgtgcaaaagctagtgggtctagtggtcgtactgcaacatatactgttaagtatggagactcactatctgcaattgctagtaaatatgggacaacgtatcaaaaaattatgcaattaaatggattaactaatttctttatctatcctggacagaagttaaaagtgcctggaggtagttctagtagctcatcttctaataatactagatcaaacggtggctattattcaccaacttttaaccatcaaaacttgtatacttggggacaatgcacatggcacgtatttaatagacgtgctgaaataggaaaaggtatcagtacatactggtggaatgcaaataattgggacaatgcatcagctgctgatggatatactattgattatcgtcctacagtaggctcaattgcacaaactgacgctggttactatggtcacgtagcgtttgtagagcgcgtgaatagcgatggaagtattttagtttcagaaatgaactggagtgcagctcctggaaatatgacatatagaacaattccagcttatcaagtgagaaattacaaatttattcatt

SEQ ID NO: 260 - DNA, 1317 bp, Staphylococcus epidermidis
gtgaccaaaaaagcttttatttcttattctagaacaagtgatgaacatttaaatagagttgtgagaataggagaaagtttgagagttgatcatggaattgatgttattttagatgtatgggattgcactgagggagatgacttgaatttttttatggagtctatggttaatgacgagacgatagattttgttattatattaagcgattttcagtattttaatagagctaatgatagagaaggaggagttggaaaagaaagcacaataattacttctcaaatttatgataagcaaaaagatagtaagtttatacctgtctttttagatattctggataatggaaaaccatcattaccaactttttgtaatactagattcgctattgatatgacagacatcgaattagatatagagaaaatagaagagattgcaagaaaaatacacgataaacctttattcgaaaaaccaagacttggtaaagtaccagattataaccaaaatcaaaatgagttaaagaaagcaataaaaaaattaactttatctaaaagttataatgaaacgagaaattttgaagaagctttagacattatttataaaactttagaaaatatagaaaatagcgtagaggaatataataaagatgatttaatgactttaaaagaggtttttgatacttggaaagaatttattacgtatgcgctaaacaatgataacttttattttagggaattaatcatagagcattataataggtgcttaaagcttacggaagaagaatttgaaaatccaatgactaggatttttaattatttttcatttcttatactagtaagtgaatctttatcttcaggagcaaatgaatttttgaaagatttattgaatgctaaatttcattttagtagaagagaagcaaattattatatattaagtttatatccccaggtgttatccaagaaatattcatataatactaatgtcaaaaaaatgttagccgaaatgtactttgaagggaaggagttaaaaaaggttcaagatgcagatgtaattttatatacagaaagtcttatgaaaaaagatattcatagtgtatatgaaacgtggcatggggttctgttgtatagtagatggcctatgcttgagcaacaaactattaatattttaataaataaatttcgtagtaaaaaatatctagatcaatttgactttttatttggaagttcacaaagagaagtatttgaaaactatgataagattaaatccacacaagaaatacctactatttttaattttattgataaagaagaaattggcagctat

SEQ ID NO: 261 - DNA, 759 bp, Staphylococcus epidermidis
atgcactatctaaagaaagtaactatatacataagtttattaattttggtgagtggttgtggagacagcaaagaaacggaaatcaaacaaaactttaataaaatgttaaatgtgtatccaactaaaaatctagaagacttttatgataaagagggttatcgtgatgaagagtttgataaggatgacaaaggaacatggattattagatctgaaatgacaaaacagccaaaaggtaagattatgacttcaaaaggtatggtgttacatatgaatagaaatactagaagtacaactggttattacgttattaggaaaatttctgaagataataaaagtgaaattgatgatgaagaaaagaaatatcctataaagatggtaaataacaagataattccaactcaaaaaattaatgacaataaattgaagaatgaaatagaaaactttaagttctttgtacaatacggaagctttaaaaattcagatgattataaagaaggggatattgaatacaatcctaatgcaccaaattattctgcacaatatcatttaagtaatgatgactataatattaaacaattaagaaaaagatatgatattaaaacgaaaaaaactcctagattattaatgagaggcgctggagatccaaaaggatcttctgtaggttataaaaatcttgaatttacatttgttaagaataatgaggaaaatatttattttaccgatagtattaattttaatccaagcaagggtaaatcattg

SEQ ID NO: 262 - DNA, 783 bp, Staphylococcus epidermidis
gtgaaacattcgaaaaagttacttttatgcatcagttttttattaataacgttttttattggtggatgtggatttatgaataaagacgatggtaaagaaacggaaatcaaacaaaactttaataaaatgttaaacgtgtatcccactaaaaatctagaaaacttttatgataaagagggctatcgagatgaagagtttgataaggatgacaaaggaacatggatagttcattctaaaatggttattgaaccaaaaggcaaaaacatggaatctagagggatggttctctttatcaatcgcaatactagaacatcaaaaggctattttatagtcaatgaaatagaaaaggatagaaaaggaagacccattaataataaaaagaaatatcctgtaaaaatgaaaaataataaaattattccaaccaaaccaatatctaatgataaattaaaaaaagaaattgaaaactttaaattttttgtacaatatggcaattttaaagatattaaaaattataaagatggtgacatttcatacaatcctaatgtacctagttattctgcaaaatatcaattgagtaataatgaatataacgtacaacaattaagaaaaagatatgacatcccaactaaaaaagtacctaaactattgttgaaaggtgatggggatttaaaaggttcatccgtaggttctaaaaatctagaatttacttttatagaaaataaagaagagaatatctattttacagattctgtactatttagccctagcgaggataatgaatca

SEQ ID NO: 263 - DNA, 759 bp, Staphylococcus epidermidis
atgcgttatctcaagaaagtaacgatatacataagtttattaattttggtaagtggttgtggaaacggtaaagaaacggaaatcaaacaaaactttaataaaatgttagacatgtatccgactaaaaatctagaagacttttatgataaagaaggctatcgagatgaagagtttgataaaaaggataaagggacatggatagttggatctaccatgacaattgaaccaaaaggcaagtacatggaatctagaggtatgtttctatatattaatcgcaatactagaacaactaaaggttattattatgtgaggaaaacaacagatgacagtaaaggtagactaaaagatgatgaaaagagatatcctgtaaaaatggaacacaataaaattattccaacgaagccaatacctaatgacaaactaaaaaaagaaatagaaaacttcaaattttttgtacaatatggagattttaaaaacttaaaggattataaagatggtgacatttcatacaatcctaatgtacctagttattctgcaaaatatcaattgagtaataatgactataatgtaaaacaattacgaaaaagatatgatattcccaccaaccaagcccctaaattattgttaaaaggagatggtgacttaaaaggctcatctataggttccaaaagtttagaatttacttttatagaaaataaagaagagaatatctttttttcagatggtgtacaatttactcctagcgaggatagtgagtca

SEQ ID NO: 264 - DNA, 777 bp, Staphylococcus epidermidis
atgaaacattcaagcaaaataatagtatttgtaagtttcttaattttaacgatttttattggaggatgtggttttataaataaagaagatagcaaagaagctgaaatcaaacaaaactttaataaaacgttaagtatgtatccaactaaaaatctagaagacttttatgataaagagggctatcgtgatgaagagtttgacaaagatgacaaagggacatggattattaattctaaaatgattgttgaaccgaaaggggaagagatggaagcaagagggatggttttacgtataaatagaaatacgagaacagctaaaggtaactttattataaaacgaataacagaaaataataaaggaatacctgatgttaaagacaaaaaatatccagtaaaaatggaacacaataaaattattccaacaaaacaaattaaagataaaaaattaaaaaaagaaattgagaacttcaaattttttgtacaatatggaaattttaaaaacttaaaggattataaagacggagagatatcttacaatcctaatgtgccaagttactcagcgcaatatcaattgaacaattatgataataatgttaaacaactaagaaaaagatatgatattcccacgaatcaagctcctaaattattattgaaaggtacaggagatttaaaaggatcctctgtaggttataaacatcttgaatttacttttgtagaaaataaaaaggaaaatatttattttactgacagtataaactttaacccgagtagggggaat

SEQ ID NO: 265 - DNA, 783 bp, Staphylococcus epidermidis
atgcgttatctcaagaaagtaactatatacataagtttattaattttaacgatttttattggaggatgtggttttataaataaagaagatagcaaagaaacggaaatcaaacaaaactttaataagatgttaaacgtgtatcctactaaaaatctagaagacttttatgataaagaaggttttcgagatgaagaatttgataaaggagataaaggaacttggattattaggtctgaaatgacaaaacagccaaaaggtaaaattatgacctcaagaggtatggttctctatatcaatcgtaacactagaacagccaaagggtattttttaatagatgagataaaagatgataatagtggtagaccgatagagaatgaaaagaaataccctgtaaaaatgaaccataataagatctttccaacaaagccaatatctgatgataaattaaaaaaagaaattgaaaacttcaaattttttgtacaatatggagattttaaaaacttaaaggattataaagacggagagatatcttacaatcctaacgttcctagttactcagcgcaatatcaattgaacaataatgataataatgttaaacaattaagaaaaagatatgatattccaaccaatcaagcccctaaattattgttaaaaggggatggcgacttaaaaggatcatctgtaggttctaaaaatttagaatttacttttgtagaaaataaagaagagaatatattttttacagatgcagtacaattcactcctagcgaggatgatgaatca

SEQ ID NO: 266 - DNA, 1536 bp, Staphylococcus epidermidis
atgaagacctataagccgtaccgacatcaattaaggcgttcgctatttgcctcaacgattttcccagtatttatggtgatgattattggtttaataagcttttatgctatttatatatgggtcgaacatcgcaccattcatcagcatacctatcaaactcaaaccgaattacaacgtatcgacaaacattttcatacgtttgttacgcagcaacaaaaacaatggcgtcatgttgatttatcacatccaactgatatcacaaagatgaaacgccaactattaaaacaagtccatcaacaacctgcgatattgtattacgatttaaaaggttcttcacaatctttcacaaacaattatgaacaattagacacaacaaagatgtatttaatatcaaaatatcgaattgattttaaagacgatacttatatccttaaaatatatatgtcaagcacaccactacttaaaaacattaagaaaaatagtggacaatctgcactcattgttgattcatatgatactgttttatatacaaatgacgaccgattctctatcggtcaaaaatatcaaccaccacagtttgggtttatgaacgagtctttaaaactcaattctcatcatgcgcatcttattatatataaagatattcatgaaaccattgaagatggaattgcattactagttgtcatgggtgttgttcttattctgcttgttatttttggatatataagcgctgatagaatggcaaagcgccaatctgaagatattgaagcgattgtccgaaaaattgatgatgctaaaaatcgacatcttggtagttacgaaccgttaaaaaaacatagtgagttagaggaaataaataattatatctatgacttgtttgaatcaaatgagcaattaatacaatctattgaacagaccgaacgtcgtttacgtgatatacaattaaaagaaattgagcgacaatttcaaccccatttcttattcaatacgatgcaaacgatacaatatttaattcctctttcacccaaagtagcacaaacagtcatacaacaactatcacaaatgctacgttattctctacgcacagcatcgcacacagtcaaattagcagaagaattaagctacattcagcagtatgttgctatacaaaatatccgcttcgatgatatgatacagctttacatcgatgctcctgaagatgtacaacatcaaacaattggtaagatgatgcttcaaccactcgtagaaaatgccatcaagcatggtcgtggtagtgaacctttaaagataacaattcgtatcagacttacgaagcgcaaattacatattctggttcatgataatggcatcggtatgtctccatcacatttagaacgcgtgcgccaatcacttcatcacgatgtttttgatacgacacacctaggtttaaatcatttacataatagagccatcattcaatatggaacatatgcacgtctgcacattttctcaagaagccatcaagggacattaatgtgttaccaaataccacttgtc

SEQ ID NO: 267 - DNA, 3091 bp, Staphylococcus epidermidis
gtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacaccaacaactaagaacccattaacaggagaaaaagttggcgaaggtgaaccaacagaaaaaataacaaaacaaccagtggatgagatcgttcattatggtggcgaagaaatcaagacaggccataaggatgaatttgatccgaacgcaccgaaaggtagtcaaacaacgcaaccaggtaagccaggagttaaaaatcctgatacaggcgaagtagtcacaccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggtgaaggtgaaccaacagaaaaaataacaaaacaaccagtggatgagatcgttcattatggtggcgaagaaatcaagccaggccataaggatgaatttgatccaaacgcaccgaaaggtagccaagaggacgttccaggtaaaccaggagttaaaaatcctgatacaggcgaagtagtcacaccaccagtggatgatgtgacaaaatatggtccagttgatggagatycgattacgtcaacggaagaaattccgtttgataaaaaacgcgaatttgatccaaacttagcgccaggtacagagaaagtcgttcaaaaaggtgaaccaggaacaaaaacaattacaacaccaacaactaagaacccattaacaggggaaaaagttggcgaaggtgaaccaacagaaaaaataacaaaacaaccagtagatgaaatcacagaatatggtggcgaagaaatcaagccaggccataaggatgaatttgatccgaacgcaccgaaaggtagccaagaggacgttccaggtaaaccaggagttaaaaatcctgatacaggcgaagtagtcacaccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacaccaacaactaagaacccattaacaggagaaaaagttggcgaaggtgaaccaacagaaaaaataacaaaacaaccagtggatgagatcgttcattatggtggcgaagaaatcaagacaggccataaggatgaatttgatccgaacgcaccgaaaggtagtcaaacaacgcaaccaggtaagccaggagttaaaaatcctgatacaggcgaagtagtcacaccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggtgaaggtgaaccaacagaaaaaataacaaaacaaccagtggatgagatcgttcattatggtggcgaagaaatcaagccaggccataaggatgaatttgatccaaacgcaccgaaaggtagccaagaggacgttccaggtaaaccaggagttaaaaatcctgatacaggcgaagtagtcacaccaccagtggatgatgtgacaaaatatggtccagttgatggagattcgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggagaaaaagttggcgaaggtgaaccaacagaaaaaataacaaaacaaccagtggatgagattgttcattatggtggtgaacaaataccacaaggtcataaagatgaatttgatccaaatgcacctgtagatagtaaaactgaagttccaggtaaaccaggagttaaaaatcctgatacaggtgaagttgttaccccaccagtggatgatgtgacaaaatatggtccagttgatggagattcgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggagaaaaagttggcgaaggtaaatcaacagaaaaagtcactaaacaacctgttgacgaaattgttgagtatggtccaacaaaagcagaaccaggtaaaccagcggaaccaggtaaaccagcggaaccaggtaaaccagcggaaccaggtacgccagcagaaccaggtaaaccagcggaaccaggtacgccagcagaaccaggtaaaccagcggaaccaggtaaaccagcggaaccaggtaaaccagcggaaccaggtaaaccagcggaaccaggtacgccagcagaaccaggtacgccagcagaaccaggtaaaccagcggaaccaggtacgccagcagaaccaggtaaaccagcggaaccaggtacgccagcagaaccaggtaaaccagcggaatcaggtaaaccagtggaaccaggtacgccagcacaatcaggtgcaccagaacaaccaaatagatcaatgcattcaacagataataaaaatcaattacctgatacaggtgaaaatcgtcaagctaatgagggaactttagtcggatctctattagcaattgtcggatcattgttcatatttggtcgtcgtaaaaaaggtaatgaaaaat

SEQ ID NO: 268 - protein, 1870 aa, Staphylococcus epidermidis
MTKKEKDYKKSLEQQKTRVKIYKSGKSWVKASINEIELLKTMGLPFLSKNEIQENVTEKTKGHKLKKSAAKTTALVGGAFTFNMLNNHQAFAASETPITSEISSNSETVANQNSTTIKNSQKETVNSTSLESNHSNSTNKQMSSEVTNTAQSSEKAGISQQSSETSNQSSKLNTYASTDHVESTTINNDNTAQQDQNKSSNVTSKSTQSNTSSSEKNISSNLTQSIETKATDSLATSEARTSTNQISNLTSTSTSNQSSPTSFANLRTFSRFTVLNTMAAPTTTSTTTTSSLTSNSVVVNKDNFNEHMNLSGSATYDPKTGIATLTPDAYSQKGAISLNTRLDSNRSFRFIGKVNLGNRYEGYSPDGVAGGDGIGFAFSPGPLGQIGKEGAAVGIGGLNNAFGFKLDTYHNTSTPRSDAKAKADPRNVGGGGAFGAFVSTDRNGMATTEESTAAKLNVQPTDNSFQDFVIDYNGDTKVMTVTYAGQTFTRNLTDWIKNSGGTTFSLSMTASTGGAKNLQQVQFGTFEYTESAVAKVRYVDANTGKDIIPPKTIAGEVDGTVNIDKQLNNFKNLGYSYVGTDALKAPNYTETSGTPTLKLTNSSQTVIYKFKDVQGPQISVDSQTREVGKTINPITITTTDNSKDVLTTTVTGLPSGLSFDQTTNTIIGTPSEVGTTTVTVNTTDATGNVTSKQFTITIQDTISPVVNVTPSQASEVFTPINPITITATDNSGKVVTHTVTGLPQGLKFDASTNSIVGTPTQIGTNTITIESTDASGNKTTTKINYEVTRNSASDSTSTSIVNSVSTSISNSTSLSDSVKASQSLSTKESTSKSLSGSLSASTSNSASIKASESASTSKKLSESASTSMSDSASIKASESASTSKKLSESASTSTSDSASIKASESASTSKKLSESASTSMSDSVSIKASESASTSKKLSESASTSTSDSASTQASESASTSKKLSESTSTSTSDSASTSTSESDSTSESTSLSDSTSASLSESTSTSTSDSASTSTSESDSNSTSTSLSESTSTSLSESTSTSTSDSASTSASVSDSNSASTSLRESTSTSLSDSTSTSTSDSASTSTSESDSDSASTSLSGSSSTSVSDSTSASTSESASTSTSISDSNSTSTSLSESTSTSLSESTSTSTSDSASTSMSVSDSNSASISLSESTSTSVSDSTSTSTSESASTSTSESDSNSASTSLSESTSTSVSDSTSTSTSDSASTSTSVSDSNSASTSLSESTSTSISDSTSTSTSDSASTSTSVSESSSTSKKLSESASTSMSDSASASTSESNSTSTSLSGSTSTSLSGSTSTSTSESASTSTSVSDSNSASTSLSESTSTSLSDSTSTSTSDSTSASTSESDSNSTSTSMSESLSTSVSDSTSTSTSDSASTSTSVSDSNSASTSLSDSTSTSISDSTSASTSDSASESASESESTSESTSVSESSSTSVSDSTSTSTSESASTSTSESESTSESTSVSESSSTSVSDSTSTSTSESASTSTSESESTSESTSLSGSSSTSVSDSTSTSTSESASTSTSVSDSNSTSTSLSESTSTSLSNSTSTSTSDSASTSTSVSDSNSASTSLSGSLSTNVSDSTSTSTSDSASTSTSESDSNSASTSLSGSLSTSISDSTSTSTSDSASTSTSESASTSTSVSESDSESTSMSVSDSNSTSTSLSDSTSTSVSDSTRTSTSDSASTSKSVSESNSASTSVSGSTSTSISDSSSTSTSMSTSETFTSQSPINSESQFIGDSLSEDTIVTQSKNTNMLNKTGKDYDLQEQRGYTDSEQHNETQSNQADNHSNNLDLLHQNRLQDKVVKQPTKGEDGVVSNGFIVAVAIVLAIFGLAKKSRKDDDDQDGSK

SEQ ID NO: 269 - protein, 235 aa, Staphylococcus epidermidis
MKKTVIASTLAVSLGIAGYGLSGHEAHASETTNVDKAHLVDLAQHNPEELNAKPVQAGAYDIHFVDNGYQYNFTSNGSEWSWSYAVAGSDADYTESSSNQEVSANTQSSNTNVQAVSAPTSSESRSYSTSTTSYSAPSHNYSSHSSSVRLSNGNTAGSVGSYAAAQMAARTGVSASTWEHIIARESNGQLHARNASGAAGLFQTMPGWGSTGSVNDQINAAYKAYKAQGLSAWGM

SEQ ID NO: 270 - protein, 307 aa, Staphylococcus epidermidis
MNKNKVIVIGSTNVDKFLNVKRFPKPGETLHINQAQKEFGGGKGANQAIAASRLAADTTFISKVGKDGNANFILEDFKKAGIHTQYILTSESEETGQAFITVDEAGQNTILVYGGANMTLSATDVEMSVDAFIGADFVVAQLEVPFEAIEQAFKIARKQNITTVLNPAPAIELPKSLLELTDIIIPNETEAELLTGISINNESDMKETATYFLDLGISAVLITLGEQGTYCAYQEQYKMIPACNVKAIDTTAAGDTFIGAFLSELNKDLSNLESAIRLANQASSLTVQRKGAQASIPTRKEVEAEYN

SEQ ID NO: 271 - protein, 277 aa, Staphylococcus epidermidis
MALKKYKPITNGRRNMTTLDFAEITKTTPEKSLLQPLPKRAGRNNQGKLTVRHHGGGHKRQYRVIDFKRNKDGIIAKVDSIQYDPNRSANIALLVYADGEKRYIIAPKGLQVGQTVESGAEADIKVGNALPLQNIPVGTVIHNIELKPGKGGQLARSAGASSQVLGKEGKYVLIRLRSGEVRMILSTCRATIGQVGNLQHELVNVGKAGRSRWKGVRPTVRGSVMNPNDHPHGGGEGRAPIGRPSPMSPWGKPTLGKKTRRGKKSSDKLIVRGRKKK

SEQ ID NO: 272 - protein, 288 aa, Staphylococcus epidermidis
MKSKFTILLFTIFSTTVLVLVIIYNKTQSQSYISTHYSNNKIKTTATLFLHGYGGSERSETFMVKQALNKNVTNEVITARVSSEGKVYFDKKLSEDAANPIVKVEFKDNKNGNFKENAYWIKEVLSQLKSQFGIQQFNFVGHSMGNMSFAFYMKNYGDDRHLPQLKKEVNIAGVYNGILNMNENVNEIIVDKQGKPSRMNAAYRQLLSLHKIYCGKEIEVLNIYGDLEDGSHSDGRVSNSSSQSLQYLLRGSTKSYQEMKFKGAKAQHSQLHENKDVANEIIQFLWET

SEQ ID NO: 273 - protein, 265 aa, Staphylococcus epidermidis
MKIGIDAGGTLIKIVQEHDNRRYYRTELTTNIQKVIDWLNNEEIETLKLTGGNAGVIADQIHHSPEIFVEFDASSKGLEILLDEQGHQIEHYIFANVGTGTSFHYFDGKDQQRVGGVGTGGGMIQGLGYLLSNITDYKELTNLAQNGDRDAIDLKVKHIYKDTEPPIPGDLTAANFGNVLHHLDNQFTSANKLASAIGVVGEVITTMAITLAREYKTKHVVYIGSSFNNNQLLREVVENYTVLRGFKPYYIENGAFSGALGALYL

SEQ ID NO: 274 - protein, 2681 aa, Staphylococcus epidermidis
MTLNNHFAYTFEERPTPKLWLCKPDGTRIERIADFSKLGGTFKFTNVNTLHFDLPLQVFSEDTKQIERNKVVDLVKNKYLIDYRYNGYRDIFVIDDIKKSANDSDFITLNLDSRASELNKKAANEIELLGSTIPQMMNKILSVYAPLWKLGHVDGKIIDVKRELTGSNTTVNALIDNICSLFDAVAIYNNINRTISFYHKDNVGTNRGLRVRENSYLKSFEDQFVSKDIVTRLYPFGQSGLTIQSVNPAGSSYIEDFSYFMSPFKRDNNRNVLQHSDYMSDELCHALLDYQEFYASKKDQAGELSKQYSAILKEHSQEDFRLNQLSATLQRLNERVELVKPKSEYIDLGTKVKNFKITVPKSSYYLIMIRNDGSFTRIKFNNKQYDIPSGEWLYIKLKTGKFNDATKFEKQLEYPLEILSANANLRVVYTRSSEGDYEEEDTKTIEEKYNLEKYKILVKDQEKVVASIERRLKAFEDQKASVIRSMNAKNFLSEKLYNERELYVFESVWTEENHTDAQELYDDAVKQMKEQKKINRTITVDLVNFIQSLDHKDDWDKLNVGDKVVFQNKIFNTKIKAYITEMQLDFQTNQVKITISDIFDYKDLDTIIAEKLAQTTSTSSQVDFHKQQIREQTGRITDMTRLIEGEWDANKKRVMAGNETVDIGSHGVKVISKENPNEFVIMVGGVIAMTRDNGETFKTGITPEGINAEMLIGKMIVGETLTFENESGTVKFDKDGLYVNSKNFHLVSNDGEEDYFDKLKREMSENAKQQTDRMLEEYKKEVSQTISEATDVRNIVDNAADILQAAFADGVITDVEKRLISETLAQLEKENREFEDKINLALNHPYITEEDTIELNNSIVEYSSMYETLVISINESVSDKMITPQESEEINQNIINFREEIKDILSLVEEIIERTKNAQLQATLEEAKDYTTRVRDDIKDELKDLNNSFKSLNSTVEESLQDNIFDAAELEAIKTVVLVTKSEYQDITNRYSSMSANTDLKSESKLDLTKSYKTLDTSFNDFVKYIDEMTMDRIADETEKVNYKKKYDTLQKNLSDYMKKYDNCILEISKKYSNDAADKVLGDFTAIATELQNDFQDVKDNWAEFKQTTLESFKDGIVTEAEKARLRVQLDMLDRESMDIEERYKSLLANQYTNTDIKNRLTASRSPYLSVHASLRKVIEQIIADGKVDESEKTLANNSLNTYNTTLTAYSKTIQEALNTLSQIISSDVASKKVEEFNGVITTISSDVDTIKKQRDGAVITYYYSGVPTLSNDPAKSWTTNDLKDLHIKDMYLDTKSGYAYTFTKSGTSYSWKPLTDQVIVSSLKQAKNAQDTADNKRRVFVTQPIPPYDQGDMWTQGSQGDIYVCGTSRATGSFVSSDWVKASKYTDDTVAKQAAKDLEDYKVKMTKDFKDLNDGVSTFKTEVVKDFKDGIVTEAEKTRLRVQLDILDRESQDIEERYNSIFNSQYADTQVKTSISNARSTYNNSLTKLRNTIQTVIEDGKVTPTEKTTANQTLTAYNNALTSYSAAIQEALNSMSKVIAQKEATSQVNQFNEVIKNINTNITDIQKQVDGAIETFYYSGVPTLTNIPASYWTTASKREAHLGDLYLDTATGVAYRFLKKGTTSPTYYWSPISDQIITDALNRAKTAQDTADGKRRVFVNTPVPPYDTGDMWTQGASGDILVCKTPKAKGGIYSISDWVKASKYTDDTVANSAVQQLNEYKRTNNLDIADLKRKTSDFEKTVVNAFDDRVISISESSSIKGQLALLNHEKDRLTRQYENIIRNSNLVGAEKTKLSTAYSNINTKLSDLSTTINSAIVDNKIVDAESKSVTSKFELYKASVNEYQIAFDNALNSIIREIASSQAKDRLDEWKRTEFSTDSDGIIERVAGAKFDSKWTDTWRNTVNPAIQQVSNITYGSENLLLNSESRSDGANTTTHSFIRYYLTRPLETGKTYTLKASVLTTDERQSGQISVYPYSPNGARETVNIKDGKITYTFTAQTESTQFLIYKDVAGQSDVDLNVTIEKAILVEGNKVTGWSPAPEETSSALRDYNTRISSAETFIEKNKEKISQIATKSDVDASLSKVATYETQYNVSSGTNYQIPLQEYNGSFFTDNYTYEVVAKNNSLSSNNVATAIFVSKGSNNGYELVELDNMSKTGANPRFVLDSKGRPSISTFSPQSTTQDISVIYTKYLGSASAINTTKSLIEQTASSIELQVKKLTAETEYNNILLNSDFSSGWEGWINVDPQYSIVDKNTFGITLPDAITNKNKKYNTVKMTYNKNTNYPSVFSNFISVGKGQEVAIGEHLTLTCYAYIPSSSKGKLTGNIYIEFAGYYEKDQKSNPMIARHEILPKDFEYNKWFRMTASTAIPSTNSEGKKINYIRACLRYDGKNQSVNNSAIFYYALPQLERGSKPTEWSLSRLDVFSTEQLAAKIALNPESVDIIARNIDFNTDSMKIYNSNGTLNISGDTLTISNNNSSNEVIINPKGFTLKKDGVVKFKNGLDTSDYSVQAYEPQFSSWNNIKATDPAAKSKYNYIRHIEPGMNGYYTINTGVYNFAVQHKQLLEVNNTKNARVNRYTYLYNKRYLKIQMSASSRGKSKLYIIFKTKTGDTTLHQEIVSSSSMVYPDITIDLQAKLGYPPNNLPDFFELQAGIAYGENNSIDGFFRIRRMAMTDTPNAEV

SEQ ID NO: 275 - protein, 416 aa, Staphylococcus epidermidis
MYNVTQHATYKTKNKRETAVLIGVHAQTDRQFNFESTMEELDALSQTCQLNVKGQITQNREQFDHKYYVGKGKIDEIKSFIEFHDIDVVVTNDELTTAQSKTLNDNLGIKIIDRTQLILEIFALRARSREGKLQVELAQLDYLLPRLHGHGKSLSRLGGGIGTRGPGETKLEMDRRHIRTRMNEIKHQLKTVVDHRERYRNKREQNQVFQIALVGYTNAGKSSWFNVLANEETYEKNILFATLDPKTRQIQVNEGFNLIISDTVGFIQKLPTTLVAAFKSTLEEAKGADVLMHVVDASHSEYRTQIDTVNQIINDLDMDHIPQVVIFNKKDLCNEQMDVPVSKSAHVFVSSRDENDKQKVKNLVIQEIKNSLSPYEEIVDSADADRLYFLKQHTLVTELIFDETQASYRIKGFKKL

SEQ ID NO: 276 - protein, 202 aa, Staphylococcus epidermidis
MMIIVMLILSYLIGAFPSGLIIGKLFFKKDIRQYGSGNTGATNSFRVLGRPAGFIVTFLDIFKGFITVFFPLWFPVHADGVISTFFTNGLIVGLFAILGHVYPIYLKFNGGKAVATSAGVVLGVNPILLLILAIIFFSVLKIFKYVSLSSIIAAISCVIGSIIIHDYILLAVSGIVSIILIIRHKSNIVRIFKGEEPKIKWM

SEQ ID NO: 277 - protein, 557 aa, Staphylococcus epidermidis
MMNHSEALTEQVFSFASELYAYGVREVVISPGSRSTPLALVFEAHPNIKTWIHPDERSAAFFALGLIKGSEKPVAILCTSGTAAANYTPAIAESQISRLPLVVLTSDRPHELRSVGAPQAINQVNMFSNYVNFQFDLPIADGSEHTIDTINYQMQIASQYLYGPHRGPIHFNLPFREPLTPDLDRVDLLTSVTKTLPHYQKSISVDDIKDILQEKNGLIIVGDMQHQAVDQILTYSTIYDLPILADPLSQLRKEKHPNVITTYDLLYRAGLNLEVDYVIRVGKPVISKKLNQWLKKTDAYQIIVQNNDQIDVFPTPPHISYEISANDFFRSLMEEPLVERKKWLQQWQSLEQQARIEISDYLKHATDEAAYVGSLIQKLTKEDTLFVGNSMPIRDVDNLLFDSEASVYANRGANGIDGVVSTALGMAAHKNVTLLIGDLSFYHDMNGLLMAKLNELHINIVLVNNNGGGIFSYLPQKRSATKYFERLFGTPTGLNFEYTALLYDFTFKRFDNLTDFKYAELSKMGSHMYEVITNRDENLHQHQNLYQKLSEIVNVTL

SEQ ID NO: 278 - protein, 1335 aa, Staphylococcus epidermidis
MAKKFNYKLPSMVALTLFGTAFTAHQANAAEQPQNQSNHKNVLDDQTALKQAEKAKSEVTQSTTNVSGTQTYQDPTQVQPKQDTQSTTYDASLDEMSTYNEISSNQKQQSLSTDDANQNQTNSVTKNQQEETNDLTQEDKTSTDTNQLQETQSVAKENEKDLGANANNEQQDKKMTASQPSENQAIETQTASNDNESQQKSQQVTSEQNETATPKVSNTNASGYNFDYDDEDDDSSTDHLEPISLNNVNATSKQTTSYKYKEPAQRVTTNTVKKETASNQATIDTKQFTPFSATAQPRTVYSVSSQKTSSLPKYTPKVNSSINNYIRKKNMKAPRIEEDYTSYFPKYGYRNGVGRPEGIVVHDTANDNSTIDGEIAFMKRNYTNAFVHAFVDGNRIIETAPTDYLSWGAGPYGNQRFINVEIVHTHDYDSFARSMNNYADYAATQLQYYNLKPDSAENDGRGTVWTHAAISNFLGGTDHADPHQYLRSHNYSYAELYDLIYEKYLIKTKQVAPWGTTSTKPSQPSKPSGGTNNKLTVSANRGVAQIKPTNNGLYTTVYDSKGHKTDQVQKTLSVTKTATLGNNKFYLVEDYNSGKKYGWVKQGDVVYNTAKAPVKVNQTYNVKAGSTLYTVPWGTPKQVASKVSGTGNQTFKATKQQQIDKATYLYGTVNGKSGWISKYYLTTASKPSNPTKPSTNNQLTVTNNSGVAQINAKNSGLYTTVYDTKGKTTNQIQRTLSVTKAATLGDKKFYLVGDYNTGTNYGWVKQDEVIYNTAKSPVKINQTYNVKPGVKLHTVPWGTYNQVAGTVSGKGDQTFKATKQQQIDKATYLYGTVNGKSGWISKYYLTAPSKVQALSTQSTPAPKQVKPSTQTVNQIAQVKANNSGIRASVYDKTAKSGTKYANRTFLINKQRTQGNNTYVLLQDGTSNTPLGWVNINDVTTQNIGKQTQSIGKYSVKPTNNGLYSIAWGTKNQQLLAPNTLANQAFNASKAVYVGKDLYLYGTVNNRTGWIAAKDLIQNSTDAQSTPYNYTFVINNSKSYFYMDPTKANRYSLKPYYEQTFTVIKQKNINGVKWYYGQLLDGKYVWIKSTDLVKEKIKYAYTGMTLNNAINIQSRLKYKPQVQNEPLKWSNANYSQIKNAMDTKRLANDSSLKYQFLRLDQPQYLSAQALNKLLKGKGVLENQGAAFSQAARKYGLNEIYLISHALVETGNGTSQLAKGGDVSKGKFTTKTGHKYHNVFGIGAFDNNALVDGIKYAKNAGWTSVSKAIIGGAKFIGNSYVKAGQNTLYKMRWNPANPGTHQYATDINWANVNAQVLKQFYDKIGEVGKYFEIPTYK

SEQ ID NO: 279 - protein, 433 aa, Staphylococcus epidermidis
VAFEFRLPDIGEGIHEGEIVKWFIKAGDTIEEDDVLAEVQNDKSVVEIPSPVSGTVEEVLVDEGTVAVVGDVIVKIDAPDAEEMQFKGHGDDEDSKKEEKEQESPVQEEASSTQSQEKTEVDESKTVKAMPSVRKYARENGVNIKAVNGSGKNGRITKEDIDAYLNGGSSEEGSNTSAASESTSSDVVNASATQALPEGDFPETTEKIPAMRKAIAKAMVNSKHTAPHVTLMDEIDVQELWDHRKKFKEIAAEQGTKLTFLPYVVKALVSALKKYPALNTSFNEEAGEVVHKHYWNIGIAADTDKGLLVPVVKHADRKSIFEISDEINELAVKARDGKLTSEEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 280 - protein, 736 aa, Staphylococcus epidermidis
MNETDEISQIYNKHRLPSLSGLAKVSPLVHRASIGGVLNVAELNRIKRLVQVQNQFKTFYNQMLEEDEEVKYPILHDKMNHLPILTDLFKEINETCDAHDLFDHASYTLQSIRSKISRTNQRIRQNLDRIVKNQGNQKKLSDAIVTVRNDRNVIPVKAEYRQDFNGIVHDQSASGQTLYIEPNSVVEMNNQISRLRNDEAVERERILTELTGFVSAEADALLIAESVMGQIDFLIAKARYARTIKGTKPTFKEDRTIYLPNAFHPLLDKDTVVANTIEFIDDVETVIITGPNTGGKTVTLKTLGLIIVMAQSGLLIPTLDGSQLSIFENVYCDIGDEQSIEQSLSTFSSHMKNIVEILQDADQNSLILFDELGAGTDPSEGAALAMSILDYVRRLGSLVMATTHYPELKAYSYNREGVMNASVEFDVETLSPTYKLLMGVPGRSNAFDISKKLGLSLNIINKAKTMIGTDEQEINAMIESLEQNSKRVDQQRIELDRLVREAQQTHDALSKQYQQYQNYETSLMDEAKEKANQRVKSATKEADEILKELRNLRDHKGAEVKEHELIDKKKQLDDQYEVKSIKQHVQKKKYDTIHTGDEVKVLSYGQKGEVLELVGDEEAVVQMGIIKMKLPIEDLEKTKKKKEKPTKMVTRQNRQTIKTELDLRGYRYEEALNELDQYLDQAVLSNYEQVYIIHGKGTGALQKGVQQHLKKHKSVRQFRGGMPSEGGFGVTVAELK

SEQ ID NO: 281 - protein, 408 aa, Staphylococcus epidermidis
MSFFKRLKDKFSSKNEDDIQKDLDESVDSNVNSDSDSMDPNDSDEQVKPKKKPKKLSEADFDEDGLISIEDFEEIEAQKIGAKFKAGLEKSRQNFQEQLNNLIARYRKVDEDFFEALEEMLITADVGFNTVMKLTDELRTEAQRRNIQETEDLREVIVEKIVEIYHQEDDHSEAMNIEDGRLNVILMVGVNGVGKTTTIGKLAYRYQQEGKKVMLAAGDTFRAGAIQQLNVWGERVGVEVVSQNEGSDPAAVVYDAINAAKNKDVDILICDTAGRLQNKSNLMQELDKMKRVINRAIPDAPHEALLCLDATTGQNALSQARSFKEVTNVSGIVLTKLDGTAKGGIVLAIRNELHIPVKYVGLGEKMDDLQPFSPESYVYGLFADMIEQNEDIPEEISRNSSVESEEGN

SEQ ID NO: 282 - protein, 551 aa, Staphylococcus epidermidis
MKRNWWKEAVAYQVYPRSFNDSNGDGIGDLPGLIEKLDYLENLGIDVIWLSPMYPSPNDDNGYDISDYKGIMSEFGTMNDFDQLLSSIHQRGMKLILDLVVNHTSDEHPWFIESKSSKTNAKRDWYIWADPKPDGSEPNNWESIFNGSTWEFDESTKQYYFHLFSKKQPDLNWENPDVRQAVFEMMNWWFEKGIDGFRVDAITHIKKNFEAGDLPVPDGKKFAPAFDVDMNQPGIQEWLQEMKDKSLSRYDIMTVGEANGVTPNDAEEWVGEENGKFNMIFQFEHLGLWSTGDTKFDVKSYKQVLNRWQKQLENVGWNALFIENHDQPRRVSTWGDDKNYWYESATSHATAYFLQQGTPFIYQGQEIGMTNYPFESIESFNDVAVKTEYQIVKKEGGDVNQLLDKYKMENRDNARTPMQWNNSINAGFTTGKPWFHVNPNYTEINVKQQLNDKFSILSYYKALIQLKKSDLIYTYGKFNMVDAENKQVFAYTRTFKNNTVLIVANLTNEVSELNLPFELDISSVDIKLHNYHLNDINLDHIKPYESFVVEI

SEQ ID NO: 283 - protein, 474 aa, Staphylococcus epidermidis
LSHRKLFPSIFHLYQQDNLDEHIAIIGIGRRDYNNEQFRDQVKASIQTYVKDTDRIDEFMTHVFYHKTDVSDKESYQSLLQFSERLDSEFALGGNRLFYLAMAPQFFGVISDYLKSSGLTQTTGFKRLVIEKPFGSDLKSAESLNNQIRRSFKEEEIYRIDHYLGKDMVQNIEVLRFANAMFEPLWNNKYISNIQVTSSEVLGVEDRGGYYESSGALKDMVQNHMLQMVALLAMEAPISLNSEDIRAEKVKVLKSLRQLKPEEVKKNFVRGQYDQGNIDGKQVKSYREEDRVAKDSVTPTFVSGKLTIDNFRWAGVPFYIRTGKRMKSKTIQVVVEFKEVPMNLYYETDNLLDSNLLVINIQPNEGISLHLNAKKNIQGIDTEPVQLSYAMSAQDKMNTVDAYENLLFDCLKGDATNFTHWEELKSTWKFVDAIQDQWTMVEPCFPNYEAGTNGPLESDLLLSRDGNHWWDDIH

SEQ ID NO: 284 - protein, 142 aa, Staphylococcus epidermidis
MIKKNKEELNDMEYLVTQENGTEPPFQNEYWNHFEKGIYVDKLSGKPLFTSEDKFESNCGWPSFSKALNDDEIVELVDKSFGMIRTEVRSEKANSHLGHVFNDGPKEKGGLRYCINSAAIQFIPYDKLEELGYGDLIKHFKK

SEQ ID NO: 285 - protein, 266 aa, Staphylococcus epidermidis
LKKLAFAITAASGAAAVLSHHDAEASTQHKVQSGESLWTIAQQYNTSVESIKQNNNLSNNMVFPGQVINVGGSASQNTSSNTSSSSASSHTVVAGESLNIIANKYGVSVDALMQANHLNGYLIMPNQILTIPNGGSGSGSGGTATQTSGNYTSPSFNHQNLYTEGQCTWYVFDKRSQAGKPISTYWSDAKYWASNAANDGYQVDNTPSVGAIMQSTPGPYGHVAYVERINGDGSILISEMNYANGPYNMNYRTIPASEVSSYAFIH

SEQ ID NO: 286 - protein, 216 aa, Staphylococcus epidermidis
MARIATKLGYPESNSFVTNTVIEFVLHNEAYPRLYRIKTRDTNLIKISQANEISRQITNGTMTLEEAKYQLEEIYVAKRDSSLPFKGIAAAIIATSFLYLQGGRLVDIITAVLAGTIGYLVVEILDRKLHAQFIPEFIGSLVIGIISVIGHAFVPSGDLATIIIAAVMPIVPGVLITNAIQDLFGGHMLMFTTKSLEALVTAFGIGAGVSSILILV

SEQ ID NO: 287 - protein, 292 aa, Staphylococcus epidermidis
MTEFDLSTREGRWKHFGSVDPVKGTKPTTKNEMTDLQSTHKNFLFEIEEVGIKNLTYPVLIDQYQTAGLFSFSTSLNKNEKGINMSRILESVEKHYDNGIELEFNTLHQLLRTLQDKMNQNAAGVDVSGKWFFDRYSPVTHIKAVGHADVTYGLAIENHTVTRKELTIQAKVTTLCPCSKEISEYSAHNQRGIVTVKAYLDKNNDVIDDYKNKILDAMEANASSILYPILKRPDEKRVTERAYENPRFVEDLIRLIAADLVEFDWIEGFDIECRNEESIHQHDAFARLKYRK

SEQ ID NO: 288 - protein, 324 aa, Staphylococcus epidermidis
VQKKYITAIIGTTALSALASTHAQAATTHTVKSGESVWSISHKYGISIAKLKSLNGLTSNLIFPNQVLKVSGSSSRATSTNSGTVYTVKAGDSLSSIAAKYGTTYQKIMQLNGLNNYLIFPGQKLKVSGKATSSSRAKASGSSGRTATYTVKYGDSLSAIASKYGTTYQKIMQLNGLTNFFIYPGQKLKVPGGSSSSSSSNNTRSNGGYYSPTFNHQNLYTWGQCTWHVFNRRAEIGKGISTYWWNANNWDNASAADGYTIDYRPTVGSIAQTDAGYYGHVAFVERVNSDGSILVSEMNWSAAPGNMTYRTIPAYQVRNYKFIH

SEQ ID NO: 289 - protein, 439 aa, Staphylococcus epidermidis
VTKKAFISYSRTSDEHLNRVVRIGESLRVDHGIDVILDVWDCTEGDDLNFFMESMVNDETIDFVIILSDFQYFNRANDREGGVGKESTIITSQIYDKQKDSKFIPVFLDILDNGKPSLPTFCNTRFAIDMTDIELDIEKIEEIARKIHDKPLFEKPRLGKVPDYNQNQNELKKAIKKLTLSKSYNETRNFEEALDIIYKTLENIENSVEEYNKDDLMTLKEVFDTWKEFITYALNNDNFYFRELIIEHYNRCLKLTEEEFENPMTRIFNYFSFLILVSESLSSGANEFLKDLLNAKFHFSRREANYYILSLYPQVLSKKYSYNTNVKKMLAEMYFEGKELKKVQDADVILYTESLMKKDIHSVYETWHGVLLYSRWPMLEQQTINILINKFRSKKYLDQFDFLFGSSQREVFENYDKIKSTQEIPTIFNFIDKEEIGSY

SEQ ID NO: 290 - protein, 253 aa, Staphylococcus epidermidis
MHYLKKVTIYISLLILVSGCGDSKETEIKQNFNKMLNVYPTKNLEDFYDKEGYRDEEFDKDDKGTWIIRSEMTKQPKGKIMTSKGMVLHMNRNTRSTTGYYVIRKISEDNKSEIDDEEKKYPIKMVNNKIIPTQKINDNKLKNEIENFKFFVQYGSFKNSDDYKEGDIEYNPNAPNYSAQYHLSNDDYNIKQLRKRYDIKTKKTPRLLMRGAGDPKGSSVGYKNLEFTFVKNNEENIYFTDSINFNPSKGKSL

SEQ ID NO: 291 - protein, 261 aa, Staphylococcus epidermidis
VKHSKKLLLCISFLLITFFIGGCGFMNKDDGKETEIKQNFNKMLNVYPTKNLENFYDKEGYRDEEFDKDDKGTWIVHSKMVIEPKGKNMESRGMVLFINRNTRTSKGYFIVNEIEKDRKGRPINNKKKYPVKMKNNKIIPTKPISNDKLKKEIENFKFFVQYGNFKDIKNYKDGDISYNPNVPSYSAKYQLSNNEYNVQQLRKRYDIPTKKVPKLLLKGDGDLKGSSVGSKNLEFTFIENKEENIYFTDSVLFSPSEDNES

SEQ ID NO: 292 - protein, 253 aa, Staphylococcus epidermidis
MRYLKKVTIYISLLILVSGCGNGKETEIKQNFNKMLDMYPTKNLEDFYDKEGYRDEEFDKKDKGTWIVGSTMTIEPKGKYMESRGMFLYINRNTRTTKGYYYVRKTTDDSKGRLKDDEKRYPVKMEHNKIIPTKPIPNDKLKKEIENFKFFVQYGDFKNLKDYKDGDISYNPNVPSYSAKYQLSNNDYNVKQLRKRYDIPTNQAPKLLLKGDGDLKGSSIGSKSLEFTFIENKEENIFFSDGVQFTPSEDSES

SEQ ID NO: 293 - protein, 259 aa, Staphylococcus epidermidis
MKHSSKIIVFVSFLILTIFIGGCGFINKEDSKEAEIKQNFNKTLSMYPTKNLEDFYDKEGYRDEEFDKDDKGTWIINSKMIVEPKGEEMEARGMVLRINRNTRTAKGNFIIKRITENNKGIPDVKDKKYPVKMEHNKIIPTKQIKDKKLKKEIENFKFFVQYGNFKNLKDYKDGEISYNPNVPSYSAQYQLNNYDNNVKQLRKRYDIPTNQAPKLLLKGTGDLKGSSVGYKHLEFTFVENKKENIYFTDSINFNPSRGN

SEQ ID NO: 294 - protein, 261 aa, Staphylococcus epidermidis
MRYLKKVTIYISLLILTIFIGGCGFINKEDSKETEIKQNFNKMLNVYPTKNLEDFYDKEGFRDEEFDKGDKGTWIIRSEMTKQPKGKIMTSRGMVLYINRNTRTAKGYFLIDEIKDDNSGRPIENEKKYPVKMNHNKIFPTKPISDDKLKKEIENFKFFVQYGDFKNLKDYKDGEISYNPNVPSYSAQYQLNNNDNNVKQLRKRYDIPTNQAPKLLLKGDGDLKGSSVGSKNLEFTFVENKEENIFFTDAVQFTPSEDDES

SEQ ID NO: 295 - protein, 512 aa, Staphylococcus epidermidis
MKTYKPYRHQLRRSLFASTIFPVFMVMIIGLISFYAIYIWVEHRTIHQHTYQTQTELQRIDKHFHTFVTQQQKQWRHVDLSHPTDITKMKRQLLKQVHQQPAILYYDLKGSSQSFTNNYEQLDTTKMYLISKYRIDFKDDTYILKIYMSSTPLLKNIKKNSGQSALIVDSYDTVLYTNDDRFSIGQKYQPPQFGFMNESLKLNSHHAHLIIYKDIHETIEDGIALLVVMGVVLILLVIFGYISADRMAKRQSEDIEAIVRKIDDAKNRHLGSYEPLKKHSELEEINNYIYDLFESNEQLIQSIEQTERRLRDIQLKEIERQFQPHFLFNTMQTIQYLIPLSPKVAQTVIQQLSQMLRYSLRTASHTVKLAEELSYIQQYVAIQNIRFDDMIQLYIDAPEDVQHQTIGKMMLQPLVENAIKHGRGSEPLKITIRIRLTKRKLHILVHDNGIGMSPSHLERVRQSLHHDVFDTTHLGLNHLHNRAIIQYGTYARLHIFSRSHQGTLMCYQIPLV

SEQ ID NO: 296 - protein, 1030 aa, Staphylococcus epidermidis
  MOD_RES (269)..(271): X = anything
VDDVTKYGPVDGDPITSTEEIPFDKKREFDPNLAPGTEKVVQKGEPGTKTITTPTTKNPLTGEKVGEGEPTEKITKQPVDEIVHYGGEEIKTGHKDEFDPNAPKGSQTTQPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKPGHKDEFDPNAPKGSQEDVPGKPGVKNPDTGEVVTPPVDDVTKYGPVDGDXITSTEEIPFDKKREFDPNLAPGTEKVVQKGEPGTKTITTPTTKNPLTGEKVGEGEPTEKITKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKTGHKDEFDPNAPKGSQTTQPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKPGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPVDGDSITSTEEIPFDKKREFDPNLAPGTEKVVQKGEPGTKTITTPTTKNPLTGEKVGEGKSTEKVTKQPVDEIVEYGPTKAEPGKPAEPGKPAEPGKPAEPGTPAEPGKPAEPGTPAEPGKPAEPGKPAEPGKPAEPGKPAEPGTPAEPGTPAEPGKPAEPGTPAEPGKPAEPGTPAEPGKPAESGKPVEPGTPAQSGAPEQPNRSMHSTDNKNQLPDTGENRQANEGTLVGSLLAIVGSLFIFGRRKKGNEK

SEQ ID NO: 297 - DNA, 1164 bp, Staphylococcus aureus
atgaataaacagatttttgtcttatattttaatattttcttgatttttttaggtatcggtttagtaataccagtcttgcctgtttatttaaaagatttgggattaactggtagtgatttaggattactagttgctgcttttgcgttatctcaaatgattatatcgccgtttggtggtacgctagctgacaaattagggaagaaattaattatatgtataggattaattttgttttcagtgtcagaatttatgtttgcagttggccacaatttttcggtattgatgttatcgagagtgattggtggtatgagtgctggtatggtaatgcctggtgtgacaggtttaatagctgacatttcaccaagccatcaaaaagcaaaaaactttggctacatgtcagcgattatcaattctggattcattttaggaccagggattggtggatttatggcagaagtttcacatcgtatgccattttactttgcaggagcattaggtattctagcatttataatgtcaattgtattgattcacgatccgaaaaagtctacgacaagtggtttccaaaagttagagccacaattgctaacgaaaattaactggaaagtgtttattacaccagttattttaacacttgtattatcgtttggtttatctgcatttgaaacattgtattcactatacacagctgacaaggtaaattattcacctaaagatatttcgattgctattacgggtggcggtatatttggggcacttttccaaatctatttcttcgataaatttatgaagtatttctcagagttaacatttatagcttggtcattattatattcagttgttgtcttaatattattagtttttgctaatgactattggtcaataatgttaatcagttttgttgtcttcataggttttgatatgatacgaccagccattacaaattatttttctaatattgctggagaaaggcaaggctttgcaggcggattgaactcgacattcactagtatgggtaatttcataggtcctttaatcgcaggtgcgttatttgatgtacacattgaagcaccaatttatatggctataggtgtttcattagcaggtgttgttattgttttaattgaaaagcaacatagagcaaaattgaaagaacaaaatatg

SEQ ID NO: 298 - DNA, 492 bp, Staphylococcus aureus
atgctattttatttatttcattttacaatcagctttatatcaacagtacttttctctatcattttcaatgcacccaaacgcctcttagtagcatgtggatttgtgggtgccattgcatggacgatttaccaattaacggtagatttagagtttggaaaagttggcgcttcatttttgggaagcttaattttaggcttaatgagtcatactatgagtcgcagatataaacgaccggtaattatattcatagtgccaggcattataccattagtacctggtggtgcagcttatcaagcgactcgttttttagtatcaaatgattatacaagtgctgtaaatacatttttagaagttacactgatttcaggtgcgattgctttcggtatattagtttctgaaattctatattacctatacacacgtatcaaacaactgtatggtaaaatcaaaggtaagacatataaaaaatcttacaacatgaataatagagtt

SEQ ID NO: 299 - DNA, 1314 bp, Staphylococcus aureus
atgataaatgcagtagtaatagcagtaattttaatgattatgctatgtttatgtcgattaaacgtagttataagcttatttatcagtgcgctagttggtggcttaatttcaggcatgagcattgaaaaagttataaatgtatttgggaaaaatatagtcgatggtgctgaggtagcattaagctatgctttattaggtggatttgcagcattaatttcatacagtggtatcacagactatttagtaggaaaaattataaatgcaattcacgctgaaaatagtcgatggtcaagagttaaagtcaaagtgacaataatcattgcattattagctatgagtatcatgagtcaaaacttaattcctgtacatattgcattcattccaattgtcatcccaccattgttaagtctgtttaatgacttaaaaatagatagacgtttaatcggtttgattatcggttttggtttatgtttcccgtatgtgttattaccatatggattcggtcaaattttccagcaaattattcaaagtggctttgcaaaggcaaatcacccaattgagtttaatatgatttggaaagcaatgcttattccttcaatggggtatattgttggcttacttatcggtttatatgtatatcgtaaaccacgtgaatatgaaacacgtaaaatttcagatagtgacaatgttacagagttaaaaccatatatcttaatagtaacaattgtagcaatactagctacatttttagtacaaacatttacagattcaatgatttttggtgcactggcaggggtactcgtattctttatttcacgtgcatataattggtatgaattagatgctaagtttgttgaaggtattaaaattatggcttatattggtgtagttattttaacagcaaatggatttgctggtgtaatgaatgctactggtgatatagatgaattagttaaaactttaacaagtattactggtgataataaattatttagcattatcatgatgtatgtgataggtttaattgtcactttaggtattggatcatcatttgcaacaattcctattatcgcatcattattcattccttttggagcgtcaattggactagatacaatggcattaatcgcattgattggaacagcgagtgcattaggtgactcaggttcgcctgcaagtgattcaacattaggaccaactgcgggattaaatgttgatggccaacatgatcatatacgtgatacatgtgtaccaaacttcttgttttataatattcctttaatgattttcggtactattgctgctatggtacta

SEQ ID NO: 300 - DNA, 291 bp, Staphylococcus aureus
atgaatcataatgttattatcgttattgcattaatcatagttgtcatttctatgttagctatgctcattcgcgttgtgctaggcccatcacttgccgatcgtgttgtcgcattagatgcgattggtcttcaattaatggcagttatagcattattcagtattttattaaatattaaatacatgattgtcgttattatgatgattggtatattagcttttttaggtactgcagtattctctaaatttatggacaaaggtaaggtgattgaacatgatcaaaatcatactgat

SEQ ID NO: 301 - DNA, 957 bp, Staphylococcus aureus
gtgaataggaatatcgttaaactagttgtgttcatgctaattttagttgtagcagtagcgggttgtggtcaaaaagatactgaagagaaaactgaaatgacgacaataaaagatgaattaggaactgaaaaaattaagaaaaatcctaaacgtgttgttgtattagaatatagttttgctgattatttagcagcattagatatgaaacctgttggtattgcagatgatggcagcactaaaaatataacaaagtcagtaagagataagattggggcatatgaatcggttggatctagaccgcaaccgaatatggaagtgataagtaaattaaaaccggatttgatcattgcagatgttagcagacataagaaaatcaaatcagaattgagcaaaattgctccgacaatcatgttagttagcggtacgggagattataatgcaaatattgaagcatttaaaacagtcgctaaagcagtaggcaaagagaaagaaggcgagaagcgtctggaaaagcatgataaaatattagcggagattagaaagaaaattgaacagagtacgttaaaatctgcatttgcattcggtatctcaagagcaggtatgtttattaataatgaagatacatttatgggacaattcttaattaaaatgggtattcaacctgaagtcacaaaagacaaaactacgcatgttggtgaacgcaagggtggtccttatatatatttaaataatgaagaacttgccaatatcaatccaaaagttatgattttagccactgacggaaaaacggacaaaaatagaacgaaattcattgatcctgcagtttggaaatcattaaaagctgtgaaagataacaaagtttatgacgttgaccgaaataagtggttgaaatcaagggggattatcgcaagtgaaagtatggcagaagatttagaaaaaattgcagaaaaagcaaaa

SEQ ID NO: 302 - DNA, 1017 bp, Staphylococcus aureus
atgactggagaacaatttactcaaattaaacgtccagtaagtagattaactgaaaaagttctaggttggttatgttgggtgatgttattagtgcttactgtcattacgatgtttatagcacttgtttcattcagtaataacacatcgattgctaatcttgaaaatacattaaacaataatgcatttatccagcaattattagctggaaatggctataatacaacacaatttgtaatatggttacaaaatggtatatgggctattatcgtttactttattgtttgtttgttgatttcatttttagctctcatatctatgaatataagaatcttgtcaggtttcttattcttaatatcagcaattgtaacgattcctttagttttacttatcgttactttaatcattccgatattattctttattattgcgatgatgctatttataagaaaagataaagttgaaatggttgcgccacaatattatgaagagtataacggaccgatttatgattatcgtgaacctgtgtatgagcgcccccaaccgaaagatgattattatgatgtgcctaaatatgaaaaagaattggataaatcaaatactgtatatgatcaagaacaggaaagagataaatatgatcaatttcctaaacgtgcagttgaaagtgaatataatcatgatgagcgcactgaggaagaaccatcagtattatccagacaggctaaatacaaacaaaaaagtactgaagaactaggtattgaagatgatggttattatgcagaacctgaagttgatccaaaagaattgaaagcacaacaaaagcgagaaaaagctgaaattaaagctaagaaaaaagaaaaacgtaaagcttataaccaacgaatgaaagaacgtaggaaaaatcaacctagcgcagttagtcaacgtcgaatgaattttgaagagcgacgtcaaatttacaacaatgatatttctgaagaacgcaattcaagtgaagttaaggacaaaaaagagcaagaa

SEQ ID NO: 303 - DNA, 1554 bp, Staphylococcus aureus
gtggaaaatacaattaatgaaagtgaaaagaaaaaacgatttaaattaaaaatgccaggtgcatttatgattttattcattttaacggttgttgcagttatagcaacatgggttattcctgctggtgcatattctaaactttcttacgaaccttcatcccaagaactaaagatagttaaccctcataaccaagtgaaaaaggttccgggtacgcaacaggaactagacaaaatgggggttaaaattaagattgaacaatttaaatcaggtgcaattaataagccggtatcaattccgaatacttatgaaagattaaagcaacatccagctggaccagaacaaataacaagtagcatggttgaaggtacgatagaagcggtcgatatcatggtattcattcttgtactagggggacttattggcgtagttcaagccagtggttcttttgaatcgggattgttagctttaacgaagaaaacaaaagggcatgaatttatgctaattgtgtttgtatcaatactaatgattatcggcgggacattatgtggtattgaagaagaagctgtagcattttatccgattttagtccctatatttatagcgttaggatacgattctatcgtttcagttggtgccatattccttgccagctctgtcggtagtacattttcaactattaacccgttctcggttgtaattgcctctaatgccgctggtacaacttttacggatggcttgtattggagaataggtgcttgtattgtcggtgcgatttttgttattagttatttatattggtactgtaaaaaaattaaaaacgatcctaaagcgtcatattcttatgaagacaaagatgcttttgaacagcaatggtctgtattaaaagatgacgatagtgcccattttactttgcgtaagaagataatccttacattatttgtactaccatttccaattatggtatggggagttatgacgcaaggttggtggttcccagttatggcttcagcatttttaatatttacaattataataatgtttattgctgggacaggtaaatctggattgggagaaaaaggaactgtagatgcatttgtcaatggtgcatcaagtttagtaggtgtatctttaattattggtttagctcgaggtattaatttagtgttgaatgaaggtatgatttcagatacaatcttacacttttcatcatctttagttcaacatatgagtggaccattatttatcatcgtattactatttattttcttctgtttaggttttatcgtgccatcatcttctggcttagcggtattatcaatgcctatctttgcaccactagctgatacagtaggtataccaagattcgtcatcgttacgacatatcaatttggtcaatatgcgatgttattcttagcgccgactggacttgttatggccacactacaaatgttaaacatgcgatattcacattggttccgatttgtatggccggtagttgcttttgtattgattttcggtggcggagtactaattacgcaagtactaatttattca

SEQ ID NO: 304 - DNA, 1248 bp, Staphylococcus aureus
atgagcttttttaaacgcttaaaagataagtttgcaacaaataaagaaaatgaagaagttaaatccttaacagaagaacaaggtcaagacaaattagaagatacacattctgaaggttcaacgcaggacgcaaatgatttagcagaaaatgctgaagtgaaaaagaagccacgcaagttgagtgaagcggattttgatgacgatggcttaatatcaattgaagattttgaagaaattgaagctcaaaaaatgggtgctaaatttaaagcaggactcgaaaaatctcgtcaaaatttccaagaacaattaaataatttgatagcgagatatcgtaaagtagatgaagacttttttgaagctttagaagaaatgttaatcactgcagacgtcggttttaatacagtgatgacgttaactgaagaattacgtatggaagcacaacgacgtaatattcaagatactgaagatttgcgtgaagtcattgttgaaaaaatcgtagagatttaccatcaagaagatgataattcagaagctatgaacttagaagatggtcgtttaaatgtcattttaatggttggtgtgaatggtgttggtaaaacaacaacaattggaaaattagcttaccgatataaaatggaaggtaaaaaagtaatgttagctgcgggcgatacttttagagcgggtgctattgatcaattgaaagtttggggcgaacgtgttggtgtagacgtaattagccaaagtgaaggttctgatccagctgctgttatgtatgatgcgattaatgccgctaaaaacaaaggtgttgatattttaatctgtgataccgctggacgtttacaaaataaaacaaatctaatgcaagaattagaaaaagttaagcgtgtaattaatcgagcagtgccagatgcgcctcatgaagcattactatgtttagatgctacaactggtcagaatgcgttgtcacaagctagaaactttaaagaagtaacaaatgttacaggtattgtattaacgaaattagatggtacagccaaaggtggtatcgtattagccattcgtaatgaattgcacatcccagttaaatatgtaggtttaggtgagcaattagatgacttacaaccatttaaccctgaaagttatgtctacggcttattcgctgatatgattgaacaaaatgaagaaataacaacagttgaaaatgatcaaattgtaacagaagaaaaggacgataatcatgggtcaaaa

SEQ ID NO: 305 - DNA, 2604 bp, Staphylococcus aureus
gtgttaaaaaagtggctaaattcaaacgtcaaacaattctttgttataactttcattagtgtaatattaacgcttattttattttctactcatatctatgattatattgtgaatggtactgtttttagcggggctggagatggattccgtcaaatgatgccatttcaaatgtatttgtatgaacatctacgtagtttttctagtttatatgatgcatcgtttggattaggtggcgattatatgaaaggactatcatattattattcgctgtcacctttaatgtggctaaattttctattcattaaaataggagaaacggttggtatatttaatccgacgacaatacatttttggccgacaaaccaacttattatggctatgatacgagctatcataacatttgtcgtgaccttctacttatttaaaatattacactttaaacgctcagcaaatatgatcgctacgattttatacggcatgtcaactgtcgttatatactttaattttacttggtcattttatggaaatttattatatttattgccattatcgattcttggtttggaaagatattttcaacaacgcaaaatcggtattttcattgttgcgatagccttaacactatttagcaatttttatttcagttattatcaagctattattataggttgctactatttatatcgactcattttcacttacaaatatgacattgtctctagaacacaaaaattaatttgcgtcatatctgctacagttttgagtgtgttatcaagtgtatttggtttattcactggcatttctgcgtttttggaaaatgacagaaagcaaaatcccaatgttgatataccgtttttgacaccacttgattatcattattttttctttagcgatggattttatattacgatttcaattcttactatcgttgcattattgtcattcaaactgtatcgtttttacttttatagacttttcgcaatagtaacatggatattatttataggttcattatcacagtatttcgacagtgcttttaatggtttttcatttccagaaaggcgttgggtgtatatcttagcactatcatcaagtgctctttgcggattgtttattcaacatttatcaacattaaatatgaaatattatttaatcagaacaatacccgtatgcatcatcgcaatactttatgtattactatcaccgacacacccacttgcacttatagtaggtattatcctgctaatagtgcttgccgttattttaaaatttagtttatggcgttataaaaaattaaccgttgcaatattagtattaatcgttatgattcaacaaatcgtcattttagataacaacaaaaacatggcaatcaaaccttatcaacaatcattatcaacgttgaaacaacatgattaccatagtaactatgtaaaccagcttataaaaaagataaatcaaaatgcaacaggctcatttaatcgcattgattatatgtcagactatgcattaaattcaccatttatatatcattataatggcatttcattatattctagtatttttaatggagacattttaaaatattatgacaagacactccaaattaatatgccaatcgataaaaacagcacttatagattacttggcaatcgtcaaaatttactatcactttggaatgttaatgatcgaattagagtgaatcatgatgacaacttaccatatggatttaaaattaagtctgaacacaaagacaataaagttcgttggattcattctaaaaataccatccattatccaagtgcacatattacaaataaggtcttttccaataaagaattaaaatctccattagataaagaacaagcaatgttgcaagggattgtttctaacaatattaaagatgttaatacacattttaaagccaataaaaatttactatcagattcaacaattaaattaaatagtgcagcctggcaatctcctacaaaacatttattacaagttaaacaaaataatggtggtctaactgtacagttgccaaaatcagtttctaatcaatttaaagatttgtattttgaaatggatttagaattactttcgccggataaagctcatgatgttaaagtgaatgaatatacacaagaaagaaataaactcacttataaatatcgacgcgttgtaacacccgtaacgatacgcattaaagctccagatagaattagattatcattgcctaaaggtaagtatcgagtaaatttaaaagggatatacggcgaagattataccacgcttaaagacgcttcaaattcattagaagctgtcaaagttagtaagacaaagcatggttatactattactaaaaataaaaattcatctgggtatattgttttgccaacagcatataatcaaggtatgaaagcgacatcaggtgatcaaagtcttaaagttgaacaagtaaatggtgttatgaccggcattaaagcacctaaaaatataacaaagattcaattgagctataccccaccatactattatttacttataacaattactatatttggcattatatgtagtattattttcacgagatgggcaagacaaaaa

SEQ ID NO: 306 - DNA, 2376 bp, Staphylococcus aureus
gtgcgtcaattggcacaagcaaaaaagaaatcgacagctaagaaaaaaacaacatcaaaaaaaagaacaaattcgaggaaaaagaagaatgataatccgatacgttatgtcatagctattttagtagttgtattaatggtgttgggtgttttccaattaggaataataggtcgtctaattgacagcttctttaattatttatttgggtacagtagatatttaacatatattttagtactcttagcaactggttttattacatactctaaacgtattcctaaaactagacgaacggctggttcgattgtattgcaaattgcattgctatttgtatcacagttagtttttcattttaatagtggtatcaaagctgaaagagaacctgtactttcttatgtgtatcagtcataccaacacagtcatttcccaaattttggtggcggtgtattaggcttttatttattagagttaagcgtacctttaatttcattatttggtgtatgtattattactattttattattatgctcaagtgttattttattaacaaaccatcaacatcgtgaagttgcaaaagttgcactggaaaatataaaagcttggtttggttcatttaatgaaaaaatgtcggaaagaaaccaagaaaaacaattgaagcgtgaagaaaaagcaagacttaaagaagaacaaaaggcacgtcaaaatgaacagccacaaataaaagatgtgagtgattttacggaagtgcctcaagaaagagatattccaatttatgggcatactgaaaatgaaagtaaaagccagagtcaaccaagtcgaaaaaaacgagtgtttgatgcagagaatagttcgaataacatcgtaaatcatcatcaagcagatcagcaagaacaattaacagaacaaactcataacagtgttgaaagtgaaaacactattgaagaagctggtgaagttacgaatgtatcgtatgttgttccaccgttaactttacttaatcaacctgcaaaacaaaaagcaacatctaaagctgaagtgcaacgtaaaggacaagtactagagaatacattaaaagattttggggtaaatgcaaaagtgacacaaattaaaattggtcctgcagtaactcaatatgaaattcaaccagctcaaggggttaaagtgagtaaaattgtaaacttgcataatgatattgcattagctttagcagcaaaagatgttagaatcgaagcgccaatacctggtcgttctgcagtaggtattgaagtgccaaatgagaaaatttcattagtttcactaaaagaagttttagatgaaaaattcccgtctaataataaactagaagttggattaggaagagatatatcaggtgatccaattactgttccactaaatgaaatgccacacttattggtggcaggatcgacgggtagtggtaaatctgtttgtataaatggtattattacaagtattttattaaatgctaagccgcatgaagttaaacttatgttaatcgatccgaaaatggttgaactaaatgtttataacggaattccacacttattaattccggttgttacaaatcctcataaagctgctcaagctttagaaaaaattgtagctgagatggaaagacgttatgatttattccaacattcatcaactagaaacattaaaggttataacgaattaatccgtaagcaaaatcaagaattagatgagaagcaaccagaattaccttatatcgttgttattgtagatgagcttgcagatttaatgatggtagctggtaaagaagttgaaaatgcgattcaacgtattacacaaatggcacgtgcagcaggtatacatttaattgtagcgacacaaagaccttctgtggatgtaattacaggtatcattaaaaataatattccatctagaatagcttttgctgtgagttctcaaacagattcaagaactattattggtactggcggcgcagaaaagttacttggtaaaggtgacatgttatacgttggaaatggtgactcatcacaaacacgtattcaaggggcgtttttaagtgaccaagaggtgcaagatgttgtaaattatgtagtagaacaacaacaggcaaattatgtaaaagaaatggaaccagatgcaccagtggataaatcggaaatgaaaagtgaagatgctttatatgatgaagcgtatttgtttgttgttgaacaacaaaaggcaagtacatcattgttacaacgccaatttagaattggttataatagagcatctaggttgatggatgatttagaacgcaatcaggtaatcggtccacaaaaaggaagcaagcctagacaagttttaatagatcttaataatgacgaggtg

SEQ ID NO: 307 - DNA, 1359 bp, Staphylococcus aureus
atggctgaaaaattacaaagggaactgagcaatcgccacatacaattaattgcaattggcggtgcaattggtacaggcttattcttaggtgctggtcaaacgattgcattaaccggcccttcaattctattaacatacatcattataggatttatgttatttatgtttatgcgaggtttaggagaaatcattatacagaatactgaatttaaatctttcgcagatgtaaccaatacatatattgggccttttgcaggatttgttaccggatggacatactggttctgttggattattacaggtatggctgaagtaacggctgtggcaaaatatgttagcttttggttcccagaaattccaaactggataagtgcactattttgtgtactgttattaatgtcattcaacctacttagcgcaagacttttcggagaattagaattttggttctctatcattaaaatagcgacaattattggtttaatagtagttggtttcgtcatgattctatttgcatttaaaactcaattcgggcatgccagtttcacaaatctatatgaacacggcatattcgctaaaggtgcttctggattctttatgtctttccaaatggcactattctcatttgtaggaattgaaatgattggtgttacagctggggaaacaaaagatccagttaaaacaattccaaaagcaattaacagtgtacccattagaattttaatattttacgttggggcgttagcggttatcatgtctattatcccttggcagcaagttgatcctgataacagtccattcgtaaaattattcgcattgatcggaattccgtttgctgcgggcttgattaattttgtagtattaaccgctgctgcttcatcatgtaacagtggtatattctcaaatagccgtatgcttttcggtttatcaagtcaacaacaagcacctccgaacttttctaagacgaataaatatggcgttccacatgttgcaatctttgcttcatcagcattattacttgtggcagcattactaaactatattttcccagatgcgacaaaagtatttacgtatgtgactaccatctctacagtgttatttttagttgtatggggtctgattatcattgcatatatcaattatagtcgtaaaaacccagatctacataaaaatgctacgtacaaactattaggtggcaaatatatgggctacttaatatttgtattcttcatttttgtgttcgggttattatttattaatgttgatacaagacgtgcaatttattttattccgatttggtttatacttttagcatttatgtacttaagatataaacgtatcgctgctaaatcaaataaa

SEQ ID NO: 308 - DNA, 6558 bp, Staphylococcus aureus
atgaatttgttaaagaaaaataaatatagtattaggaagtataaagtaggcatattctctactttaatcggaacagttttattactttcaaacccaaatggtgcacaagccttaactacggataataatgtacaaagcgatactaatcaagcaacacctgtaaattcacaagataaagatgttgctaataatagaggtttagcaaatagtgcgcagaatacacctaatcaatctgcaacaaccaatcaagcaacgaatcaagcattggttaatcataataatggtagtatagtaaatcaagctacgccaacatcagtgcaatcaagtacgccttcagcacaaaacaataatcatacagatggcaatacaacagcaactgagacagtgtcaaacgctaataataatgatgtagtgtcgaataataccgcattaaatgtaccaactaaaacaaatgaaaatggttcaggaggacatctaactttaaaggaaattcaagaagatgttcgtcattcttcaaataaaccagagctagttgcaattgctgaaccagcatctaatagaccgaaaaagagaagtagacgtgcggcaccggcagatcctaatgcaactccagcagatccagcggctgcagcggtaggaaacggtggtgaaccagttgcaattacagcgccatatacgccaacaactgatcctaatgccaataatgcaggacaaaatgcacctaacgaagtgctgtcatttgatgacaatggtattagaccaagtaccaaccgttctgtgccaacagtaaacgttgttaataacttgccgggcttcacactaatcaatggtggcaaagtaggggtgtttagtcatgcaatggtaagaacgagcatgtttgattcaggagataataagaactatcaagcacaaggaaatgtaattgcattaggtcgtatacatggaactgatacgaatgaccatggcgattttaatggtatcgagaaagcattaacagtaaatccgaattctgaattaatctttgaatttaatacaatgactactaaaaacggtcaaggcgcaacaaatgttattatcaaaaatgctgatactaatgatacgattgctgaaaagactgttgaaggcggtccaactttgcgtttatttaaagtacctgataatgtgagaaatctcaaaattcaatttgtacctaaaaatgacgcaataacagatgcgcgtggcatttatcaactaaaagatggttacaaatactatagctttgttgactctatcggacttcattctgggtcacatgtttttgttgaaagacgaacaatggatccaacagcaacaaataataaagagtttactgtaacaacatcattaaagaataatggtaattctggtgcttctctagatacaaatgactttgtatatcaagttcaattacctgaaggtgttgaatatgtgaacaattcattgactaaagattttccaagtaacaattcaggcgttgatgttaatgatatgaatgttacatatgatgcagcaaatcgtgtgataacaattaaaagtactggaggaggtacagcaaactctccggcacgacttatgcctgataaaatactcgatttaagatataaattacgtgtaaataatgtgccgacaccaagaacagtaacatttaacgagacattaacgtataaaacatatacacaagatttcattaattcagctgcagaaagtcatactgtaagtacaaatccatatactatcgatatcatcatgaataaagatgcattacaagccgaagttgacagacgtattcaacaagctgattatacatttgcgtcattagatatctttaatggtctgaaacgacgcgcacaaacgattttagatgaaaatcgtaacaatgtaccattaaataaaagagtttctcaagcatatattgattcattaactaatcaaatgcaacatacgttaattcgaagtgttgatgctgaaaatgcagttaataaaaaagttgaccaaatggaagatttagttaatcaaaatgatgaattgacagatgaagaaaaacaagcagcaatacaagttatcgaggaacataaaaatgaaataattggtaatattggtgaccaaacgactgatgatggcgttactagaatcaaagatcaaggtatacagaccttaagtggggatactgcaacaccggttgttaaaccaaatgctaaaaaagcaatacgtgataaagcaacgaaacaaagggaaattatcaatgcaacaccagatgttactgaagacgagattcaagatgcactaaatcaattagctacggatgaaacagatgctattgataatgttacgaatgctactacaaatgctgacgttgaaacagctaaaaataatggcatcaatactattggagcagttgttcctcaagtaactcataaaaaagctgcaagagatgcaattaaccaagcaacagcaacgaaaagacaacaaataaatagtaatagagaagcaactcaggaagagaaaaatgcagcattgaacgaattaactcaagcaaccaaccatgctttagaacaaatcaatcaagcaacaacaaatgctgatgttgataacgccaaaggagatggtctaaatgccattaatccaattgctcctgtaactgttgttaagcaagctgcaagggatgccgtatcacatgatgcacaacaacatatcgcagagatcaatgctaatcctgatgcgactcaagaagaaagacaagcagcaattgacaaagtgaatgctgctgtaactgcagcaaacacaaacattttaaacgctaataccaatgctgatgttgaacaagtaaagacaaatgcgattcaaggaatacaagcaattacaccagctacaaaagtaaaaacagatgcaaaaaatgccatcgataaaagtgcggaaacgcaacataatacgatatttaataataatgatgcgacgctcgaagaacaacaagcagcacaacaattacttgatcaagctgtagccacagcgaagcaaaatattaatgcagcagatacgaatcaagaagttgcacaagcaaaagatcagggcacacaaaatatagtagtgattcaaccggcaacacaagttaaaacggatactcgcaatgttgtaaatgataaagcgcgagaggcgataacaaatatcaatgctacaactggcgcgactcgagaagagaaacaagaagcgataaatcgtgtcaatacacttaaaaatagagcattaactgatattggtgtgacgtctactactgcgatggtcaatagtattagagacgatgcagtcaatcaaatcggcgcagttcaaccgcatgtaacgaagaaacaaactgctacaggtgtattaaatgatttagcaactgctaaaaagcaagaaattaatcaaaacacaaatgcaacaactgaagaaaagcaagtggctttaaatcaagtggatcaagagttagcaacggcaattaataatataaatcaagctgatacaaatgcggaagtagatcaagcgcaacaattaggtacaaaagcaattaatgcgattcagccaaatattgttaaaaaacctgcagcattagcacaaatcaatcagcattataatgctaaattagctgaaatcaatgctacaccagatgcaacgaatgatgagaaaaatgctgcgatcaatactttaaatcaagacagacaacaagctattgaaagtattaaacaagctaacacaaatgcagaagtagaccaagctgcgacagtagcagagaataatatcgatgctgttcaagttgatgtagtaaaaaaacaagcagcgcgagataaaatcactgctgaagtggcgaagcgtattgaagcggttaaacaaacacctaatgcaactgacgaagaaaagcaggctgctgttaatcaaatcaatcaacttaaagatcaagcaattaatcaaattaatcaaaaccaaacaaatgatcaggtagacacaactacaaatcaagcggtaaatgctatagataatgttgaagctgaagtagtaattaaaccaaaggcaattgcagatattgaaaaagctgttaaagaaaagcaacagcaaattgataatagtcttgattcaacagataatgagaaagaagttgcttcacaagcattagctaaagaaaaagaaaaagcacttgcagctattgaccaagctcaaacgaatagtcaggtgaatcaagcagcaacaaatggtgtatcagcgattaaaattattcaacctgaaacaaaagttaaaccagctgcacgtgaaaaaatcaatcaaaaagcgaatgaattacgtgctaagattaatcaggataaagaagcaacagcagaagaaagacaagtagcactagataaaatcaatgaatttgtaaatcaagccatgacagatattacgaataatagaacaaatcaacaagttgatgatacaacaagtcaagcgcttgatagcattgctttagtgacgcctgaccatattgttagagcagctgctagagatgcagttaagcaacaatatgaagctaaaaagcgcgaaattgagcaagcggaacatgcgactgatgaagaaaaacaagttgctttaaatcaattagcgaataatgaaaaacgtgcattacaaaacatcgatcaagcaatagcgaataatgatgtgaaacgtgttgaaacaaatggcattgctacactaaaaggtgtacaacctcatattgtaattaagcctgaagcacaacaagcaataaaagcaagtgcagaaaatcaagtagaatcaataaaagatacaccacatgcaacagttgatgaattagatgaagcgaatcaattaattagcgacacactcaaacaagcgcaacaagaaatagaaaatacaaatcaagatgctgctgttactgatgttagaaatcaaacaatcaaggcaatagagcaaataaaacctaaagtaagacgtaaacgagctgcgcttgatagcattgaagaaaataataaaaatcaactcgatgcaatccgaaatacgttggatactactcaagatgaaagagatgttgctattgatactttaaataaaattgtaaatacaattaaaaatgacattgcacaaaacaaaacgaatgcagaagtggatcgaactgagactgatggcaacgacaacatcaaagtgattttacctaaagttcaagttaaaccagcagcgcgtcaatctgttggtgtaaaagccgaagctcaaaatgcactaatcgatcaaagcgatttatcaactgaagaagaaagactagctgctaaacatttagtagaacaagcacttaatcaggctattgatcagatcaatcatgcagataagactgcccaagttaatcaagatagtataaatgctcaaaatattatttcaaaaattaaaccagcgacaacagttaaagcaacagcattacaacaaattcaaaatatcgctacaaataaaattaatttaattaaagcaaataacgaagcgacagatgaagaacaaaatattgcaatagcacaagttgaaaaagagttaattaaagctaaacaacaaattgctagtgcagtgactaatgcagatgtggcatatttattgcatgatgagaaaaacgaaattcgtgaaatcgaacctgttattaacagaaaggcgtctgctcgagaacaattgacaacattattcaacgataaaaaacaagcaattgaagcgaatattcaagcaacggtagaagaaagaaatagtatattagcacagttacaaaatatttatgacactgctattggacaaattgatcaagatcgtagcaatgcacaagttgataaaacagcatcattaaatctacaaacaatacatgatttagatgtacatcctattaaaaagccagatgctgaaaaaacgattaatgatgatcttgcacgcgtcactgctttagtgcaaaattatcgaaaagtaagtaatcgtaataaggctgatgcattaaaagctataactgctttaaaattacaaatggatgaagaattaaaaacagcacgcactaatgctgatgttgatgcagttttaaaacgatttaatgttgcattaagcgatatagaagcagtaattactgaaaaagaaaatagcttactgcgaattgataacattgctcaacaaacatatgcgaaattcaaagcgatcgcaacaccagaacaattagctaaagtaaaagtattaattgatcaatatgttgcagatggcaatagaatgattgatgaagatgcgacattaaatgacatcaaacaacacacgcaattcattgttgatgaaattttagcaattaaattaccagctgaagcgacgaaagtatcaccaaaagaaattcagccagctccaaaagtttgtacgcctattaaaaaagaagagacacatgaatcgcgcaaagttgaaaaagaacttccaaatacaggttctgaaggaatggatttaccattgaaagaatttgcactgattacaggtgcggctttgttagctagaagacgtactaaaaacgaaaaagaatca

SEQ ID NO: 309 - DNA, 444 bp, Staphylococcus aureus
atgagtgttgaaatagaatcaattgaacatgaactagaagaatcaattgcatcattgcgacaagcaggcgtaagaattacacctcaaagacaagcaatattacgttatttaatttcttcacatactcatccaacagctgatgaaatttatcaagcactttcacctgattttccaaatataagtgttgcgacaatatataataacttaagagtgtttaaagatattggaattgtaaaagaattaacatatggagactcatcaagtcgattcgactttaatacacataatcattatcatattatatgtgaacaatgtggtaagattgttgattttcaatatccacagttaaatgaaattgaaagattagctcagcatatgactgactttgacgtaacacatcatcgaatggaaatttatggagtttgtaaagaatgccaagataaa

SEQ ID NO: 310 - DNA, 1182 bp, Staphylococcus aureus
atgagtgaaaaacaacaaattctcgattatatagaaacaaataaatatagttatatcgaaatcagtcatagaattcatgaacgtcctgaacttggtaatgaagaaatatttgcgtctcgaactttaatagatcgtttgaaagagcatgattttgaaattgaaaccgagattgctgggcatgcaactgggtttatagcgacatatgattcaggacttgacgggccagctataggttttttagcagaatacgatgctttgccaggattgggtcatgcttgtggtcataatatcattggaactgcaagtgttcttggtgcaattggtttgaagcaagtgattgaccaaattggtggtaaagtagtcgttcttggatgtccagctgaagaaggtggggaaaatggtagcgctaaagcttcttatgtcaaggctggtgtgattgatcaaatagacattgccttaatgattcatccgggaaatgaaacttataaaacgattgatactttggcagtggatgttttagatgttaaattttacggaaaaagtgctcatgcctctgaaaatgcagatgaagcgttaaatgcattagacgctatgattagttattttaatggtgtagcacaactacgacaacatattaaaaaagatcaacgtgtgcatggtgtgattttagatggcgggaaagcagctaatattattccagactatacacatgctcgtttttatactagagcaatgacgcgtaaagaattggatatattaacagaaaaagtaaatcaaatcgcacgtggagctgcgatacagactggttgtgattatgaatttggtcgaattcaaaacggtgtgaatgaattcattaaaacgccgaaattagatgatttatttgctaaatatgctgaagaagttggtgaagcagttattgatgatgattttggttatggctctacggatacagggaacgtaagtcatgttgtgccaacaatacatcctcatattaaaataggatcacgtaatttagtaggacatacgcatagatttagagaagcggctgcgagtgtacatggtgatgaagcattaattaaaggcgctaaaataatggcgttgatggggttagagttaattacaaatcaagacgtttatcaagacattattgaagagcatgcgcatttgaaagggaatgggaag

SEQ ID NO: 311 - DNA, 1929 bp, Staphylococcus aureus
atgactacgaccttcattattagctacattattttagcgctcattattgttggggttatcaatttatttttaataagatcaagaaaaaaaggcaaacgccaacaaaaggaacaacaatttacgacacgtcaatcaaatcaatctaaatttaaagctagtgatttagacaaaacaactgatcaatcgacacaacgtatgacgcatgaagagttgcgtgttgacaatcaagatgatcatagccaagttagtctaaatggttacacaaaggggtctgagaaagatcaagaagcattcactaataataaggatgaggaagcagttgctgctaaaaatcctgaatcagaagaatataaagtgaatgaaaaaataaaaaaagaacataaaaactttatttttggtgaaggtgtttcacgcggtaaaatattagcggcattattattcggtatgtttattgcgattttaaaccaaacattattaaatgttgctttaccaaaaattaatacggaatttaatatttctgcgtcaacagggcaatggttgatgacgggattcatgttagtaaacggtattttaataccaattacggcgtatctatttaataaatattcatatcgaaaattatttttagttgcgttagtactctttacaattggttcattaatctgtgcgatttcaatgaatttcccaatcatgatggttggacgtgtattacaagccattggtgcaggtgtactaatgccattaggttcaattgttattattacaatttatccacctgaaaaacgtggtgctgccatgggtacaatgggtatcgcaatgattttagcacctgcaattggtccaacattatcaggttatattgtacaaaattaccattggaatgtgatgttttacggtatgttcattatcgggattatcgctattttaattggttttgtatggtttaagttatatcaatatacaacaaaccctaaagctgatatcccaggtatcatttttagtacgattggttttggtgctttgttatatggtttctcagaagctggcaacaaaggttggggttcagtagagatagaaacaatgtttgcgattggtattatctttattattctattcgttattagagaattaagaatgaaatcaccaatgttgaatttagaagtattgaaattcccaacatttacattaacaacaattattaatatggttgtaatgttaagtttatatggtggtatgattttattaccgatttatttacaaaatttacgcggattctcagcattagattccggattgttattattacctggttctctaattatgggtctactaggaccatttgcaggtaaattgttagatactattggtttaaaaccattagctatctttggtattgctgtaatgacttatgcaacatgggaattaactaaattaaatatggatacaccatatatgacaatcatgggtatctatgtacttcgttcatttggtatggcatttataatgatgccaatggtaactgcagctattaatgcgttaccgggacgacttgcctctcatggtaatgctttcttaaatacgatgcgtcaattagcaggctctataggtacagcaatcttagttactgtaatgacaacacaaactacacaacacttatcagcttttggggaagagttagataaaacgaatcctgttgtacaagatcatatgcgtgaattagcatcacaatatggcggacaagaaggcgcaatgaaagtgttactacaatttgtaaataaactagcaacggttgaaggtattaatgatgcatttatagttgcaacgatatttagcatcatcgccttaattttatgtttatttttacaaagtaataaaaaagcaaaagctacagctcaaaagttagatgcagataatagtatcaatcatgaa

SEQ ID NO: 312 - DNA, 927 bp, Staphylococcus aureus
atgattaaaaataaaatattaacagcaactttagcagttggtttaatagcccctttagccaatccatttatagaaatttctaaagcagaaaataagatagaagatatcggccaaggtgcagaaatcatcaaaagaacacaagacattactagcaaacgattagctataactcaaaacattcaatttgattttgtaaaagataaaaaatataacaaagatgccctagttgttaagatgcaaggcttcattagctctagaacaacatattcagacttaaaaaaatatccatatattaaaagaatgatatggccatttcaatataatatcagtttgaaaacgaaagactctaatgttgatttaattaattatcttcctaaaaataaaattgattcagcagatgttagtcagaaattaggctataatatcggcggaaacttccaatcagcgccatcaatcggaggcagtggctcattcaactactctaaaacaattagttataatcaaaaaaactatgttactgaagtagaaagtcagaactctaaaggtgttaaatggggagtgaaagcaaattcattcgttacaccgaatggtcaagtatctgcatatgatcaatacttatttgcacaagacccaactggtccagcagcacgagactatttcgtcccagataatcaactacctcctttaattcaaagtggctttaatccatcatttattacaacattgtcacacgaaagaggtaaaggtgataaaagcgagtttgaaatcacttacggcagaaacatggatgctacatatgcttacgtgacaagacatcgtttagccgttgatagaaaacatgatgcttttaaaaaccgaaacgttacagttaaatatgaagtgaactggaaaacacatgaagtaaaaattaaaagcatcacacctaag

SEQ ID NO: 313 - DNA, 1209 bp, Staphylococcus aureus
atgcaatcaacgaaaaccaaaacgaagcatttttcatttttattgctaattacgttaggcgtcatgaccgcttttggcccactaactatagatatgtacgtaccatcattacctaaagtgcaaggtgattttggttctactacatcagaaattcaattaacattatcattcacaatgattggtcttgcactaggccaatttatctttggacctttatccgatgcttttggtcgcaaacggattgctgtatccattttgatcattttcattttggtatcaggtttgtctatgtttgttgatcaattgccattattcttaactttacgatttattcaaggtttaactggtggtggcgtcatcgtgattgcaaaagcctctgctggtgataaatttagtggcaacgcactcgctaaatttttagcatctttaatggtagttaatggcatcatcactattcttgcaccattagccggtggattagctttatccgtagcaacatggcgttctattttcacaattttaactattgtggcactcatcattttaattggcgtcgcttctcaattacctaaaacatctaaagatgaattaaagcaggtgaattttagtagcgtcattaaagattttggaagtcttttgaaaaaaccagcatttattattccaatgctattacaaggtttaacttatgtaatgctatttagttattcatctgcatcgccatttattactcaaaaattgtataatatgacaccccaacaatttagtatcatgtttgctgttaacggtgtaggtttaatcattgtcagtcaagtcgttgctttattagtagaaaaattacatcgccacatattattaatcattttaactattatacaagtggtaggtgttgctttaattatcctgacacttacattccatttaccactttgggtcttactcatcgcattcttcttaaatgtgtgtcctgtgacgtcaattggaccgcttggtttcacaatggctatggaagaacgaacaggtggcagtggtaacgcatcaagtttacttggcttattccaatttatcttaggtggcgctgttgcaccattagttggcttaaaaggcgaatttaatacatcaccatatatgattattatcttcattacagccattctattagtcagtctacaaatcatttactttaaaatgattaaaaagcaacatgtcgca

SEQ ID NO: 314 - DNA, 678 bp, Staphylococcus aureus
atgatgtatggatatccagagaaatggttggaaggtatgacaactggagaaggtatcgcggcagaattacgcttaggcattgtgaatggtcacatagctgaaggtacgttactcactgaaaatcaaatggcaaagcaatttaatgtgagtcgttcgccaattcgagatgcatttaaattattgcaacaaaatcaactcatccaattagaaagaatgggtgcacatgtgttgccgtttggggaacaagaaaagaaagaaatgtatgatttgcgactgatgttagagtcatttgcattttcaagagttaaaaatcaagagcgactacctatcgtaaaagaaatgaagaaacaacttgaaatgatgaaagtggcagtaaaatttgaggatgcagaatcatttacgaagcatgactttgaatttcatgaaacattaatcaaagcatctaatcatcaatatttaaactcattttggagtcatttaaaaccagtaatgatggcactcgttttaacatccatgcgacaacgtatgcaacagaacccgcaagattttgaacgcatacatcataatcatcaagtgtttattgatgcagtggaacaatacgacagtcaaattttgaaagaagcgtttcatttaaatttcgacgatgttggtaaagatattgaaggattttggttgaat

SEQ ID NO: 315 - DNA, 1446 bp, Staphylococcus aureus
atgggaagttttttcaataaaatagcacgaaaagaggatccggctatctatcaaaataaagatggtcatttaaagcgtacacttcgggtgcgtgatttcttagctttaggtgtaggaacaattgtatcgacatctatctttacgctacctggcattgttgctgcagaacatgcaggaccggccgttgcgttatcattcttactcgctgctattgttgctggtttagttgcatttacttatgcagaaatggctgccgctatgccatttgcaggttcagcctattcttgggtcaatgtattatttggtgaattttttggatgggttgccggttgggctctattagctgaatattttatcgccgtagcctttgttgcatcaggattctcagcgaatttacgcggacttgtgaaaccaattggcatcgaattacctgcagcattatcaaatccatttggtacaaatggcggttttatcgatattattgctgctatcgttattttattaactgcattattactatcacgtggtatgtcggaagcagctcgtatggaaaatattttagttattttaaaagtattagctattattttatttgtcatcgtaggtttaacagcaataaatgttagtaactatgtgccatttattccagaacacaaagtaactgctacaggtgactttggtggatggcaaggcatatatgctggtgtttcaatgattttcttagcgtatatcggtttcgattctatcgcagcaaactcagcagaagcacttgatcctcaaaagacaatgcctagaggtattcttggttctttaagcgttgctatcgtattatttattgctgtagcacttgtgttagttggtatgttccattactcacaatacgcaaacaatgctgaacctgttggttgggctttacgtcaaagtggtcatggtgttgtagcagctattgttcaagctatctctgttatcggtatgtttacagcattaattggtatgatgttagcaggctcacgtttactttattcatttggacgtgacggcttattaccttcatggttaagccacttaaacgacaaacatttacctaatcgcgcactagttatacttactattattggtgttttaattggttctatgttcccattcgcatttttagcacaattaatttcagcaggtacacttgttgcatttatgttcgtttcattagcaatgtatcgtttgagaaagcgtgaaggtaaagatctaccaattcctgcatttaaattacctttatatcctgtgttaccagcaattacatttgttttagtattgctagtattctggggattaggattcgaagcgaaattatacactttaatttggtttattgttggtatcatcctatatttaagttatggacttagacattctaagaaaaatgacgtagctgaataccacccaccaaaa

SEQ ID NO: 316 - DNA, 1368 bp, Staphylococcus aureus
atgaatagtgataatatgtggttaacagtaatggggctcattattattatttcaattgtaggtttactcattgccaaaaagataaatccagttgtaggtatgacaatcataccttgcttaggggcaatgattttaggatatagtgtgacagatttggttggattttttgctaaagggttagatcaagtcatcaacgttgttattatgtttatctttgccattattttctttggcatcatgaacgatagtggtttattcaagccgcttgtcaaacgcttaatattaatgacacgaggcaatgtcgtcattgtctgtgcaatgacagctttaattggcacaatagcccaattagatggggccggtgcggtaacatttttgctttctattcctgcattattacctttatataaagcgttaaatatgaataaatatttattgattttactattagcattaagcgcggcgattatgaacatggtaccttggggaggtccaatggctcgtgtagctgcagtgttaaaagccaaaagtgtcaatgaattatggtatggattaatacctattcaaataataggtttcattcttgttatgttgtttgcggtatatcttggatttaaagaacagaaacgtatcaaaaaagcaatagagagaaatgaattaccgcaaacacaagatatagatgtacataaattagttgaagtatatgaacgagatcaagatgtaaggtttcctgtaaaaggacgtgcaagaacaaaatcatggataaaatgggtgaatacagctttaactttagctgttattctatcgatgttaataaatattgcgccacctgaatttgcattcatgataggtgtttcgttggcacttgttattaattttaaatcagtggatgaacaaatggaacgattaagagcgcatgcgccgaatgcattaatgatggctgcagtgattattgcagcaggtatgtttttaggtgtactaaatgaaaccggtatgcttaaagcgattgcgaccaatttaatcaaagtgattcctgcagaagtaggaccatacttgcatattattgtaggtttacttggcgtaccattagatttactaactagcacagacgcttattattttgctgtgttaccgattgtcgaacaaacagcagggcaatttggtgtaccgtctgtatcaacagcttattcaatggtcatagggaatattataggtacatttgtcagcccattttcaccagccttatggttggcaattggtttagcagaggcaaacatgggcacgtatattaagtatgcattcttttggatttggggattcgctatcgttatgttagtaattgcaatgttgatgggcattgtgacgatt

SEQ ID NO: 317 - DNA, 1416 bp, Staphylococcus aureus
atggaaaacacggttaaatatcgtaagtttatactccctatcgttgtaggtctccttatttgggcacttacaccttttaaaccggatgctgtggatccaacagcatggtatatgttcgcaatattcgtcgcgacaatcattgcttgtattacacaaccgatgccaattggggccgtctctataattggatttacaatcatggtactcgttggcattgttgacatgaaaacggctgtcgctggttttggtaataatagcatttggttaattgctatggcatttttcatttcgagaggatttgtgaaaacaggtcttggtagacgtatcgcacttcatttcgtcaaattatttggtaaaaaaacattaggattagcatattctatcgtcggtgtagatttaattctagcgcctgctacaccaagtaataccgcgcgtgctggtggaatcatgttcccaattatcaaatcactttctgaatcatttggttcgaaaccgaaagacggatcagcacgcaaaatgggtgcatttcttgttttcacagaattccaaggtaatttaattactgcggctatgtttttaactgcaatggccggtaacccccttgcacaaaatttagcatctagcacatctaatgttcacattacatggatgaattggtttctagctgctttagttcctggacttgtttccttaattgttgtaccttttattatttataaaatttatccaccaactgttaaagaaacaccaaatgctaagagttgggctgaaaatgaattagcgactatgggtaaaatcgctttagctgaaaaatttatgattggtatttttgtcgttgcgttaacactatggattgtcggaagtttcattcatattgatgcaactttaacggcctttattgcgctagcattgttattattgacaggcgtcttaacatggcaagacattttaaacgaaacaggtgcttggaacacattagtatggttctcagtattagtgttaatggccgaccaattaaacaagcttggatttattccttggttaagtaaatccattgctacaagtcttggtggcttaagctggcctatagtcctggtcattttaatattgttctacttctattcacattacttatttgcaagttctacagcacatatcagtgcgatgtatgcagcattactaggcgttgccatcgcagccggtgcaccaccattattcagtgcattaatgttaggtttcttcggtaacctattagcttcaacaacacactatagtagtggtccagcgccgattctattctcttcaggttacgtgactcaaaaacgttggtggacaatgaacttaatattaggtttcgtctactttattatctggattggtttaggatcactttggatgaaagtaattggtatattt

SEQ ID NO: 318 - DNA, 990 bp, Staphylococcus aureus
atgaataaagtaattaaaatgcttgttgttacgcttgctttcctacttgttttagcaggatgtagtgggaattcaaataaacaatcatctgataacaaagataaggaaacaacttcaattaaacatgcaatgggtacaactgaaattaaagggaaaccaaagcgtgttgttacgctatatcaaggtgccactgacgtcgctgtatctttaggtgttaaacctgtaggtgctgtagaatcatggacacaaaaaccgaaattcgaatacataaaaaatgatttaaaagatactaagattgtaggtcaagaacctgcacctaacttagaggaaatctctaaattaaaaccggacttaattgtcgcgtcaaaagttagaaatgaaaaagtttacgatcaattatctaaaatcgcaccaacagtttctactgatacagttttcaaattcaaagatacaactaagttaatggggaaagctttagggaaagaaaaagaagctgaagatttacttaaaaagtacgatgataaagtagctgcattccaaaaagatgcaaaagcaaagtataaagatgcatggccattgaaagcttcagttgttaacttccgtgctgatcatacaagaatttatgctggtggatatgctggtgaaatcttaaatgatttaggattcaaacgtaataaagacttacaaaaacaagttgataatggtaaagatattatccaacttacatctaaagaaagcattccattaatgaacgctgatcatatttttgtagtaaaatcagatccaaatgcgaaagatgctgcattagttaaaaagactgaaagcgaatggacttcaagtaaagagtggaaaaatttagacgcagttaaaaacaaccaagtatctgatgatttagatgaaatcacttggaacttagctggcggatataaatcttcattaaaacttattgacgatttatatgaaaagttaaatattgaaaaacaatcaaaa

SEQ ID NO: 319 - DNA, 1254 bp, Staphylococcus aureus
atgattaatcagtctatatggcgcagtaactttcgcattttatggctcagtcagtttatagcgattgctggactgacagtacttgtgccattattgccaatttatatggcatcactacaaaatctatcagtcgtagaaatacagttgtggagtggtatagcgattgctgctccagctgtaacgacgatgatagcttcgccgatatgggggaagctaggtgataagatcagccgaaaatggatggtgttaagagcgttacttggtttggcggtatgcttatttttaatggcattgtgtacgacaccattacagtttgtacttgtgaggttattgcagggactatttggtggtgttgttgatgcatcaagtgcgtttgcgagtgcagaggcgccagctgaagatcgtggaaaggtattaggaagactgcaaagttcagtcagcgcagggtctcttgtggggccattaattggcggtgttacagcttcgatattaggttttagtgcgttactgatgagtattgccgttattacttttattgtctgtattttcggtgcattaaaattgattgaaacgacacatatgccaaaatcacaaacaccaaatattaataaaggtattcgccgttcatttcaatgtctattatgcacacaacaaacatgtcgatttattatcgttggcgttttagcaaactttgctatgtatggcatgctaactgcattatcaccacttgcttcatcagtgaatcatacagcgatagatgaccgtagtgtgattggatttttacagtccgcattttggacggcttcgatattaagcgcgcctttatggggacgctttaatgataaatcatatgttaaatcagtatatatatttgccacgattgcatgtggttgtagtgcgatactgcaaggtttagcgacgaatatagagtttttaatggctgcaagaatacttcaaggattaacatatagtgcattgattcaaagtgtcatgtttgttgtcgtgaatgcgtgtcatcaacaacttaaaggcacatttgttggaacgacgaacagtatgttagttgttggtcaaattattggcagtcttagtggcgctgccattacaagttatactacaccagctactacgtttatcgttatgggcgtagtatttgcagtaagtagtttatttttaatttgttcaaccatcactaatcaaatcaacgatcacacattaatgaaattatgggagttgaaacaaaaaagtgcaaaa

SEQ ID NO: 320 - DNA, 555 bp, Staphylococcus aureus
atgaagcgattattcgatgtagtgagttcaatatatggtttagtagttttaagtccgattctgttaattacagcattactaattaaaatggaatcacctggaccagccattttcaaacaaaaaagaccgacgattaataatgaattgtttaatatttataagtttagatcaatgaaaatagacacacctaatgttgcaactgatttaatggattcaacatcgtatataacaaagacagggaaggtcattcgtaagacctctattgatgaattgccacaattattgaatgttttaaaaggagaaatgtcaattgtaggtcctagaccagcgctttataatcaatacgaattaatcgaaaaacgtacaaaagcgaacgtgcatacgattagaccaggtgtgacaggactagctcaagtgatggggagagatgatatcactgatgatcaaaaagtagcgtatgatcattattacttaacacatcaatctatgatgcttgatatgtatatcatatataaaacaattaaaaatatcgttacttcagaaggtgtgcatcac

SEQ ID NO: 321 - DNA, 1161 bp, Staphylococcus aureus
atggcacaacttaattcaaagatagcttccttaaaattattcgcaagttacgccatagcaacttatattttagttatattaacgagtgcattaaatctttttaaaggttatgtggccgatacgttctatattgctgaaacattgctaatcgttttaaccatcattttaattattattttaacaacggaacaaacatggaagcatcatgacctatggcgacgtatcgtcgaagtgttgttattgttgatgacattaacaggcaacgtatttacattattaatgtttgtaagtattagacgttaccaacgtacatcgcaaatacatagttataacgggtgggaatcgtttatacgaaaaactactagacatcgtattgcgattatcgggttacttattttagtctacatgctgacattatcaattgtgtcacaatttacatttgatacgacattggctactaaaaatcagttcaatgcactgttacatggaccgagtctagcctatccgtttggtactgatgatttcggtagagacttatttacacgcgtagttgtaggaacgaagctgacattttcaatttcaattatttcagtagttattgcagttatttttggtgtgttactaggcactatcgcaggttattttaatcatattgataatttaataatgcgaattttagatgtagtgtttgcaattccatcattattgttagcggtggcaattattgcatcatttggagcaagtattccaaatttaattattgctttaagtatcggtaatataccatcatttgcacggacaatgcgtgccagtgttttagaaattaaacgcatggaatatgtagatgcagcacgtatcactggtgaaaacacttggaatatcatatggcgttatattttaccgaatgcgattgcgcctatgattgtacgtttttcattaaatataggtgtggttgtattaacaacaagtagtttaagtttcctaggacttggtgttgcacctgatgtagctgaatggggcaacattttacgtaccggtagtaactacttggaaacgcacagtaatttagctattgtacctggtgtttgtattatgttcgtcgttttagcatttaattttataggtgatgcagtgcgtgatgcactagatccaagaattcat

SEQ ID NO: 322 - DNA, 1164 bp, Staphylococcus aureus
atgaaaacaatacatttgtttcgcatctaccactcttttttattgaaaaagtggtatttgattatctatttactatttatattagcggcactccttattacattaacgacaatccaacatgtaacagaagatgacaatcattttaatataggtgtcgtagataaagatcaatcaagtgaaacgaaattaatcttaaactctattggtaaagggagtaacctaggaaaaaacgtgagcattaaagcatatgatgataagcaagcacatactttgttaaaaaaacataaacttcaaggctattttgtttttgataaaggtatgaccaaggcattttataaacaaggcgaactaccaatttcagtatatacatatgatcaacaatccatgaaaagtgtcgtgctatctcagctaacagattctgtttaccaacgtcttatgcgatcaatgggtggcatcttagcttttcaagacttagcaccgaaagcatcacattctgacagtatcaatgttatgactgatttgctgattacaggattaaaccgttcaggtgcatttaacttagaaccgattcatttatacgatacgggcagttattatgcaattacaggatttttaacaacggtattcatctttgcactatctttatttacagttttgaaaatgaatcaagatactgtattgaaagcgcgattgaaaatgtttcatttttctaaagagcgtttattaatcattcgtacgttgattacatggttttatactatgttatggagtatcgttggtgtagtttggattgtgttcagtattccgaatatctttgaattatataattggccaacgttagccattcatttaagctattatgttacctttttaatactgtggttattactcatcgaacttttaacaacaggcttgttgaatagtattagtaaagtcatattagctattgtcatcctggtgttatctggtttaacaatacctacgatttttttacaacatatagcaaatggtgttttcaatattcaaccgttcgcagttgtaacaaatcaattgttagaaattattttaaacaactacattttagaactgcaccctagtttctatcttagcttcatcgcacttttgataattaatttagctgtattggtttggaggtatcgtcaa

SEQ ID NO: 323 - DNA, 1305 bp, Staphylococcus aureus
ttgaaaaaacaagttattatttcgggcctcatgttattttcactattttttggagccggaaatttaatattcccgcccatgcttggccatacagcgggtcaaaatatgtggattggtatgctaggctttgcccttacaggcatattactcccctttattactgttattgttgttgcattttatgatgaaggtgttgaaagtgtaggcaatcgtatacatccatggttcgggtttatttttgctgtcgtgatttacatgtctatcggagcattttacggtattccacgtgctgcaaatgtcgcgtacgaaattggtacaagacacattttacctgtgcataaccaatggactttaattatattcgcagcaatcttttttgccatcgtttactggattagtttaaatccatcgaaaatcgttgataatttaggtaaattattaacaccgttattactattaatggtcgctctattaagtattgctgtcattttcaaccctgaatctgcactaagtgcacctaaggataaatatataacacatcctttcatttcaggaagtttggaaggctattttacaatggatcttgttgctgcgttagctttttccgtagtcattgtcaatggctataagtttaaaggcctcacagatcgcatgaaaattttaaaatatgtctgcttttcaggtcttattgcagccatattacttggaatgatttactttgcacttgcatacgttggggcatcaacagctccaggaaactttaaagatggtacagatatattgacgtacaactcattacgattatttggttcgttcggtaacctcgtatttggaatgacggttatccttgcatgcctaacaacatgtataggactcgtcaatgcttgcgccacatttactaagaaacacgtacctaagttttcttataaaatattcgcacttattttctctatcatagggttcttatttacaacacttggtttagaaatgattttaaaaattgctgtcccattattgactttaatatatcccgtgtcgattgcacttgtactcatatcatttgctaacatgtttagcacattcagattcagttgggcctatcgactcgcaactgttattacattgattatttcaattttacaaatactaaatagtttcaacttattacacggtgttattttgaaatcgtttatgatgttacctttagcagatatcgatttagcttggcttgtaccattcatgctctttgctattatcggtttcataatcgatgtatttatacgccgtccgaaacaagcgacaact

SEQ ID NO: 324 - DNA, 1710 bp, Staphylococcus aureus
gtgaaacattatttgactaaatttgtagcaatgctaataactgctgctatggtgtgtagctttgggttactgaaaagtcaggcagcagaacaacaaagtattagtgatgtatatagtgtgataacggatgcgaaatctgcactttctaataattcgatatcgaatgacaataagcagaaagcaattgagcaagtggtaagtgcagttaagaaattatcgcttgaagataatagtgaaagtaatgctgtcaaatcagatgtgagaaagcttgaagatgcaaaagcgaatgataatcaaaaagatacactttcgcaattaacgaagtcattaattgcttatgaagagaaattggctagtaaagatgcgggttctaaaattaaactattgcaacagcaagtcgatgctaaagatgctgcgatgacaaaagcgattaaagataaaaataaagcggaattagaatctttgaacaatagtttgaatcagatttggacaagtaatgaaacagtgattcgcaattatgacgcaaatcaatatggacaaattgaagtcgcattattacaacttagaattgcaattcataagtcaccattagatacggcaaaagtgtcacatgcttggacaacttttaaatcaaatattgatcatgtcgataaaaaaagtaatacgtctgcaaatgatcaataccatgtatcacaattaaatgatgcgttagagaaggcgattaaagctatcgacgacaatcaattgtcggatgctgatgctgcgcttacacattttatagaaacttggccgtatgttgaaggtcaaattcaaactaaagacggtgctttgtatacgaaaattgaagataaaataccatattatcaaagtgtattagacgaacataataaagcacatgtgaaagatggtttagtagatttaaataaccaaattaaagaggttgttggccatagttatagcttcgtcgatgtgatgattatctttttacgtgaagggctagaagtgttgttaattgtaatgacattgactaccatgacgcgtaatgtaaaagataagaaagggactgcaagtgtgattggtggtgcaattgccggacttgtactgagtattatcttagcaattacgtttgtagaaactttagggaatagtggcattcttcgtgaaagtatggaagcgggattaggtatcgttgcggtcatattaatgtttatcgttggtgtttggatgcacaaacgttcaaatgcaaaacgttggaatgacatgattaaaaatatgtatgctaatgcgattagtaatggtaatttggtattgttagcgacgattggtttaatatctgtgttgcgtgaaggtgtcgaggttatcattttctatatggggatgataggtgagctagcgaccaaagattttattattggtattgctttagctatcgttattttaatcatctttgcattattatttagatttatagttaaattaatacctattttctatatatttagagtgttgtcgatctttatttttattatgggattcaaaatgcttggcgtaagtattcaaaagttacaattattaggtgcgatgccaagacatgttattgaaggattcccaacgattaactggttgggcttttatccaagttatgaaccattgatagcacaaggtgcttatattatggtagttgctatcttaatctttaaatttaaaaaa

SEQ ID NO: 325 - protein, 388 aa, Staphylococcus aureus
MNKQIFVLYFNIFLIFLGIGLVIPVLPVYLKDLGLTGSDLGLLVAAFALSQMIISPFGGTLADKLGKKLIICIGLILFSVSEFMFAVGHNFSVLMLSRVIGGMSAGMVMPGVTGLIADISPSHQKAKNFGYMSAIINSGFILGPGIGGFMAEVSHRMPFYFAGALGILAFIMSIVLIHDPKKSTTSGFQKLEPQLLTKINWKVFITPVILTLVLSFGLSAFETLYSLYTADKVNYSPKDISIAITGGGIFGALFQIYFFDKFMKYFSELTFIAWSLLYSVVVLILLVFANDYWSIMLISFVVFIGFDMIRPAITNYFSNIAGERQGFAGGLNSTFTSMGNFIGPLIAGALFDVHIEAPIYMAIGVSLAGVVIVLIEKQHRAKLKEQNM

SEQ ID NO: 326 - protein, 164 aa, Staphylococcus aureus
MLFYLFHFTISFISTVLFSIIFNAPKRLLVACGFVGAIAWTIYQLTVDLEFGKVGASFLGSLILGLMSHTMSRRYKRPVIIFIVPGIIPLVPGGAAYQATRFLVSNDYTSAVNTFLEVTLISGAIAFGILVSEILYYLYTRIKQLYGKIKGKTYKKSYNMNNRV

SEQ ID NO: 327 - protein, 438 aa, Staphylococcus aureus
MINAVVIAVILMIMLCLCRLNVVISLFISALVGGLISGMSIEKVINVFGKNIVDGAEVALSYALLGGFAALISYSGITDYLVGKIINAIHAENSRWSRVKVKVTIIIALLAMSIMSQNLIPVHIAFIPIVIPPLLSLFNDLKIDRRLIGLIIGFGLCFPYVLLPYGFGQIFQQIIQSGFAKANHPIEFNMIWKAMLIPSMGYIVGLLIGLYVYRKPREYETRKISDSDNVTELKPYILIVTIVAILATFLVQTFTDSMIFGALAGVLVFFISRAYNWYELDAKFVEGIKIMAYIGVVILTANGFAGVMNATGDIDELVKTLTSITGDNKLFSIIMMYVIGLIVTLGIGSSFATIPIIASLFIPFGASIGLDTMALIALIGTASALGDSGSPASDSTLGPTAGLNVDGQHDHIRDTCVPNFLFYNIPLMIFGTIAAMVL

SEQ ID NO: 328 - protein, 97 aa, Staphylococcus aureus
MNHNVIIVIALIIVVISMLAMLIRVVLGPSLADRVVALDAIGLQLMAVIALFSILLNIKYMIVVIMMIGILAFLGTAVFSKFMDKGKVIEHDQNHTD

SEQ ID NO: 329 - protein, 319 aa, Staphylococcus aureus
MNRNIVKLVVFMLILVVAVAGCGQKDTEEKTEMTTIKDELGTEKIKKNPKRVVVLEYSFADYLAALDMKPVGIADDGSTKNITKSVRDKIGAYESVGSRPQPNMEVISKLKPDLIIADVSRHKKIKSELSKIAPTIMLVSGTGDYNANIEAFKTVAKAVGKEKEGEKRLEKHDKILAEIRKKIEQSTLKSAFAFGISRAGMFINNEDTFMGQFLIKMGIQPEVTKDKTTHVGERKGGPYIYLNNEELANINPKVMILATDGKTDKNRTKFIDPAVWKSLKAVKDNKVYDVDRNKWLKSRGIIASESMAEDLEKIAEKAK

SEQ ID NO: 330 - protein, 339 aa, Staphylococcus aureus
MTGEQFTQIKRPVSRLTEKVLGWLCWVMLLVLTVITMFIALVSFSNNTSIANLENTLNNNAFIQQLLAGNGYNTTQFVIWLQNGIWAIIVYFIVCLLISFLALISMNIRILSGFLFLISAIVTIPLVLLIVTLIIPILFFIIAMMLFIRKDKVEMVAPQYYEEYNGPIYDYREPVYERPQPKDDYYDVPKYEKELDKSNTVYDQEQERDKYDQFPKRAVESEYNHDERTEEEPSVLSRQAKYKQKSTEELGIEDDGYYAEPEVDPKELKAQQKREKAEIKAKKKEKRKAYNQRMKERRKNQPSAVSQRRMNFEERRQIYNNDISEERNSSEVKDKKEQE

SEQ ID NO: 331 - protein, 518 aa, Staphylococcus aureus
MENTINESEKKKRFKLKMPGAFMILFILTVVAVIATWVIPAGAYSKLSYEPSSQELKIVNPHNQVKKVPGTQQELDKMGVKIKIEQFKSGAINKPVSIPNTYERLKQHPAGPEQITSSMVEGTIEAVDIMVFILVLGGLIGVVQASGSFESGLLALTKKTKGHEFMLIVFVSILMIIGGTLCGIEEEAVAFYPILVPIFIALGYDSIVSVGAIFLASSVGSTFSTINPFSVVIASNAAGTTFTDGLYWRIGACIVGAIFVISYLYWYCKKIKNDPKASYSYEDKDAFEQQWSVLKDDDSAHFTLRKKIILTLFVLPFPIMVWGVMTQGWWFPVMASAFLIFTIIIMFIAGTGKSGLGEKGTVDAFVNGASSLVGVSLIIGLARGINLVLNEGMISDTILHFSSSLVQHMSGPLFIIVLLFIFFCLGFIVPSSSGLAVLSMPIFAPLADTVGIPRFVIVTTYQFGQYAMLFLAPTGLVMATLQMLNMRYSHWFRFVWPVVAFVLIFGGGVLITQVLIYS

SEQ ID NO: 332 - protein, 416 aa, Staphylococcus aureus
MSFFKRLKDKFATNKENEEVKSLTEEQGQDKLEDTHSEGSTQDANDLAENAEVKKKPRKLSEADFDDDGLISIEDFEEIEAQKMGAKFKAGLEKSRQNFQEQLNNLIARYRKVDEDFFEALEEMLITADVGFNTVMTLTEELRMEAQRRNIQDTEDLREVIVEKIVEIYHQEDDNSEAMNLEDGRLNVILMVGVNGVGKTTTIGKLAYRYKMEGKKVMLAAGDTFRAGAIDQLKVWGERVGVDVISQSEGSDPAAVMYDAINAAKNKGVDILICDTAGRLQNKTNLMQELEKVKRVINRAVPDAPHEALLCLDATTGQNALSQARNFKEVTNVTGIVLTKLDGTAKGGIVLAIRNELHIPVKYVGLGEQLDDLQPFNPESYVYGLFADMIEQNEEITTVENDQIVTEEKDDNHGSK

SEQ ID NO: 333 - protein, 868 aa, Staphylococcus aureus
MLKKWLNSNVKQFFVITFISVILTLILFSTHIYDYIVNGTVFSGAGDGFRQMMPFQMYLYEHLRSFSSLYDASFGLGGDYMKGLSYYYSLSPLMWLNFLFIKIGETVGIFNPTTIHFWPTNQLIMAMIRAIITFVVTFYLFKILHFKRSANMIATILYGMSTVVIYFNFTWSFYGNLLYLLPLSILGLERYFQQRKIGIFIVAIALTLFSNFYFSYYQAIIIGCYYLYRLIFTYKYDIVSRTQKLICVISATVLSVLSSVFGLFTGISAFLENDRKQNPNVDIPFLTPLDYHYFFFSDGFYITISILTIVALLSFKLYRFYFYRLFAIVTWILFIGSLSQYFDSAFNGFSFPERRWVYILALSSSALCGLFIQHLSTLNMKYYLIRTIPVCIIAILYVLLSPTHPLALIVGIILLIVLAVILKFSLWRYKKLTVAILVLIVMIQQIVILDNNKNMAIKPYQQSLSTLKQHDYHSNYVNQLIKKINQNATGSFNRIDYMSDYALNSPFIYHYNGISLYSSIFNGDILKYYDKTLQINMPIDKNSTYRLLGNRQNLLSLWNVNDRIRVNHDDNLPYGFKIKSEHKDNKVRWIHSKNTIHYPSAHITNKVFSNKELKSPLDKEQAMLQGIVSNNIKDVNTHFKANKNLLSDSTIKLNSAAWQSPTKHLLQVKQNNGGLTVQLPKSVSNQFKDLYFEMDLELLSPDKAHDVKVNEYTQERNKLTYKYRRVVTPVTIRIKAPDRIRLSLPKGKYRVNLKGIYGEDYTTLKDASNSLEAVKVSKTKHGYTITKNKNSSGYIVLPTAYNQGMKATSGDQSLKVEQVNGVMTGIKAPKNITKIQLSYTPPYYYLLITITIFGIICSIIFTRWARQK

SEQ ID NO: 334 - protein, 792 aa, Staphylococcus aureus
MRQLAQAKKKSTAKKKTTSKKRTNSRKKKNDNPIRYVIAILVVVLMVLGVFQLGIIGRLIDSFFNYLFGYSRYLTYILVLLATGFITYSKRIPKTRRTAGSIVLQIALLFVSQLVFHFNSGIKAEREPVLSYVYQSYQHSHFPNFGGGVLGFYLLELSVPLISLFGVCIITILLLCSSVILLTNHQHREVAKVALENIKAWFGSFNEKMSERNQEKQLKREEKARLKEEQKARQNEQPQIKDVSDFTEVPQERDIPIYGHTENESKSQSQPSRKKRVFDAENSSNNIVNHHQADQQEQLTEQTHNSVESENTIEEAGEVTNVSYVVPPLTLLNQPAKQKATSKAEVQRKGQVLENTLKDFGVNAKVTQIKIGPAVTQYEIQPAQGVKVSKIVNLHNDIALALAAKDVRIEAPIPGRSAVGIEVPNEKISLVSLKEVLDEKFPSNNKLEVGLGRDISGDPITVPLNEMPHLLVAGSTGSGKSVCINGIITSILLNAKPHEVKLMLIDPKMVELNVYNGIPHLLIPVVTNPHKAAQALEKIVAEMERRYDLFQHSSTRNIKGYNELIRKQNQELDEKQPELPYIVVIVDELADLMMVAGKEVENAIQRITQMARAAGIHLIVATQRPSVDVITGIIKNNIPSRIAFAVSSQTDSRTIIGTGGAEKLLGKGDMLYVGNGDSSQTRIQGAFLSDQEVQDVVNYVVEQQQANYVKEMEPDAPVDKSEMKSEDALYDEAYLFVVEQQKASTSLLQRQFRIGYNRASRLMDDLERNQVIGPQKGSKPRQVLIDLNNDEV

SEQ ID NO: 335 - protein, 453 aa, Staphylococcus aureus
MAEKLQRELSNRHIQLIAIGGAIGTGLFLGAGQTIALTGPSILLTYIIIGFMLFMFMRGLGEIIIQNTEFKSFADVTNTYIGPFAGFVTGWTYWFCWIITGMAEVTAVAKYVSFWFPEIPNWISALFCVLLLMSFNLLSARLFGELEFWFSIIKIATIIGLIVVGFVMILFAFKTQFGHASFTNLYEHGIFAKGASGFFMSFQMALFSFVGIEMIGVTAGETKDPVKTIPKAINSVPIRILIFYVGALAVIMSIIPWQQVDPDNSPFVKLFALIGIPFAAGLINFVVLTAAASSCNSGIFSNSRMLFGLSSQQQAPPNFSKTNKYGVPHVAIFASSALLLVAALLNYIFPDATKVFTYVTTISTVLFLVVWGLIIIAYINYSRKNPDLHKNATYKLLGGKYMGYLIFVFFIFVFGLLFINVDTRRAIYFIPIWFILLAFMYLRYKRIAAKSNK

SEQ ID NO: 336 - protein, 2186 aa, Staphylococcus aureus
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGEPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDVTEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 337 - protein, 148 aa, Staphylococcus aureus
MSVEIESIEHELEESIASLRQAGVRITPQRQAILRYLISSHTHPTADEIYQALSPDFPNISVATIYNNLRVFKDIGIVKELTYGDSSSRFDFNTHNHYHIICEQCGKIVDFQYPQLNEIERLAQHMTDFDVTHHRMEIYGVCKECQDK

SEQ ID NO: 338 - protein, 394 aa, Staphylococcus aureus
MSEKQQILDYIETNKYSYIEISHRIHERPELGNEEIFASRTLIDRLKEHDFEIETEIAGHATGFIATYDSGLDGPAIGFLAEYDALPGLGHACGHNIIGTASVLGAIGLKQVIDQIGGKVVVLGCPAEEGGENGSAKASYVKAGVIDQIDIALMIHPGNETYKTIDTLAVDVLDVKFYGKSAHASENADEALNALDAMISYFNGVAQLRQHIKKDQRVHGVILDGGKAANIIPDYTHARFYTRAMTRKELDILTEKVNQIARGAAIQTGCDYEFGRIQNGVNEFIKTPKLDDLFAKYAEEVGEAVIDDDFGYGSTDTGNVSHVVPTIHPHIKIGSRNLVGHTHRFREAAASVHGDEALIKGAKIMALMGLELITNQDVYQDIIEEHAHLKGNGK

SEQ ID NO: 339 - protein, 643 aa, Staphylococcus aureus
MTTTFIISYIILALIIVGVINLFLIRSRKKGKRQQKEQQFTTRQSNQSKFKASDLDKTTDQSTQRMTHEELRVDNQDDHSQVSLNGYTKGSEKDQEAFTNNKDEEAVAAKNPESEEYKVNEKIKKEHKNFIFGEGVSRGKILAALLFGMFIAILNQTLLNVALPKINTEFNISASTGQWLMTGFMLVNGILIPITAYLFNKYSYRKLFLVALVLFTIGSLICAISMNFPIMMVGRVLQAIGAGVLMPLGSIVIITIYPPEKRGAAMGTMGIAMILAPAIGPTLSGYIVQNYHWNVMFYGMFIIGIIAILIGFVWFKLYQYTTNPKADIPGIIFSTIGFGALLYGFSEAGNKGWGSVEIETMFAIGIIFIILFVIRELRMKSPMLNLEVLKFPTFTLTTIINMVVMLSLYGGMILLPIYLQNLRGFSALDSGLLLLPGSLIMGLLGPFAGKLLDTIGLKPLAIFGIAVMTYATWELTKLNMDTPYMTIMGIYVLRSFGMAFIMMPMVTAAINALPGRLASHGNAFLNTMRQLAGSIGTAILVTVMTTQTTQHLSAFGEELDKTNPVVQDHMRELASQYGGQEGAMKVLLQFVNKLATVEGINDAFIVATIFSIIALILCLFLQSNKKAKATAQKLDADNSINHE

SEQ ID NO: 340 - protein, 309 aa, Staphylococcus aureus
MIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 341 - protein, 403 aa, Staphylococcus aureus
MQSTKTKTKHFSFLLLITLGVMTAFGPLTIDMYVPSLPKVQGDFGSTTSEIQLTLSFTMIGLALGQFIFGPLSDAFGRKRIAVSILIIFILVSGLSMFVDQLPLFLTLRFIQGLTGGGVIVIAKASAGDKFSGNALAKFLASLMVVNGIITILAPLAGGLALSVATWRSIFTILTIVALIILIGVASQLPKTSKDELKQVNFSSVIKDFGSLLKKPAFIIPMLLQGLTYVMLFSYSSASPFITQKLYNMTPQQFSIMFAVNGVGLIIVSQVVALLVEKLHRHILLIILTIIQVVGVALIILTLTFHLPLWVLLIAFFLNVCPVTSIGPLGFTMAMEERTGGSGNASSLLGLFQFILGGAVAPLVGLKGEFNTSPYMIIIFITAILLVSLQIIYFKMIKKQHVA

SEQ ID NO: 342 - protein, 226 aa, Staphylococcus aureus
MMYGYPEKWLEGMTTGEGIAAELRLGIVNGHIAEGTLLTENQMAKQFNVSRSPIRDAFKLLQQNQLIQLERMGAHVLPFGEQEKKEMYDLRLMLESFAFSRVKNQERLPIVKEMKKQLEMMKVAVKFEDAESFTKHDFEFHETLIKASNHQYLNSFWSHLKPVMMALVLTSMRQRMQQNPQDFERIHHNHQVFIDAVEQYDSQILKEAFHLNFDDVGKDIEGFWLN

SEQ ID NO: 343 - protein, 482 aa, Staphylococcus aureus
MGSFFNKIARKEDPAIYQNKDGHLKRTLRVRDFLALGVGTIVSTSIFTLPGIVAAEHAGPAVALSFLLAAIVAGLVAFTYAEMAAAMPFAGSAYSWVNVLFGEFFGWVAGWALLAEYFIAVAFVASGFSANLRGLVKPIGIELPAALSNPFGTNGGFIDIIAAIVILLTALLLSRGMSEAARMENILVILKVLAIILFVIVGLTAINVSNYVPFIPEHKVTATGDFGGWQGIYAGVSMIFLAYIGFDSIAANSAEALDPQKTMPRGILGSLSVAIVLFIAVALVLVGMFHYSQYANNAEPVGWALRQSGHGVVAAIVQAISVIGMFTALIGMMLAGSRLLYSFGRDGLLPSWLSHLNDKHLPNRALVILTIIGVLIGSMFPFAFLAQLISAGTLVAFMFVSLAMYRLRKREGKDLPIPAFKLPLYPVLPAITFVLVLLVFWGLGFEAKLYTLIWFIVGIILYLSYGLRHSKKNDVAEYHPPK

SEQ ID NO: 344 - protein, 456 aa, Staphylococcus aureus
MNSDNMWLTVMGLIIIISIVGLLIAKKINPVVGMTIIPCLGAMILGYSVTDLVGFFAKGLDQVINVVIMFIFAIIFFGIMNDSGLFKPLVKRLILMTRGNVVIVCAMTALIGTIAQLDGAGAVTFLLSIPALLPLYKALNMNKYLLILLLALSAAIMNMVPWGGPMARVAAVLKAKSVNELWYGLIPIQIIGFILVMLFAVYLGFKEQKRIKKAIERNELPQTQDIDVHKLVEVYERDQDVRFPVKGRARTKSWIKWVNTALTLAVILSMLINIAPPEFAFMIGVSLALVINFKSVDEQMERLRAHAPNALMMAAVIIAAGMFLGVLNETGMLKAIATNLIKVIPAEVGPYLHIIVGLLGVPLDLLTSTDAYYFAVLPIVEQTAGQFGVPSVSTAYSMVIGNIIGTFVSPFSPALWLAIGLAEANMGTYIKYAFFWIWGFAIVMLVIAMLMGIVTI

SEQ ID NO: 345 - protein, 472 aa, Staphylococcus aureus
MENTVKYRKFILPIVVGLLIWALTPFKPDAVDPTAWYMFAIFVATIIACITQPMPIGAVSIIGFTIMVLVGIVDMKTAVAGFGNNSIWLIAMAFFISRGFVKTGLGRRIALHFVKLFGKKTLGLAYSIVGVDLILAPATPSNTARAGGIMFPIIKSLSESFGSKPKDGSARKMGAFLVFTEFQGNLITAAMFLTAMAGNPLAQNLASSTSNVHITWMNWFLAALVPGLVSLIVVPFIIYKIYPPTVKETPNAKSWAENELATMGKIALAEKFMIGIFVVALTLWIVGSFIHIDATLTAFIALALLLLTGVLTWQDILNETGAWNTLVWFSVLVLMADQLNKLGFIPWLSKSIATSLGGLSWPIVLVILILFYFYSHYLFASSTAHISAMYAALLGVAIAAGAPPLFSALMLGFFGNLLASTTHYSSGPAPILFSSGYVTQKRWWTMNLILGFVYFIIWIGLGSLWMKVIGIF

SEQ ID NO: 346 - protein, 330 aa, Staphylococcus aureus
MNKVIKMLVVTLAFLLVLAGCSGNSNKQSSDNKDKETTSIKHAMGTTEIKGKPKRVVTLYQGATDVAVSLGVKPVGAVESWTQKPKFEYIKNDLKDTKIVGQEPAPNLEEISKLKPDLIVASKVRNEKVYDQLSKIAPTVSTDTVFKFKDTTKLMGKALGKEKEAEDLLKKYDDKVAAFQKDAKAKYKDAWPLKASVVNFRADHTRIYAGGYAGEILNDLGFKRNKDLQKQVDNGKDIIQLTSKESIPLMNADHIFVVKSDPNAKDAALVKKTESEWTSSKEWKNLDAVKNNQVSDDLDEITWNLAGGYKSSLKLIDDLYEKLNIEKQSK

SEQ ID NO: 347 - protein, 418 aa, Staphylococcus aureus
MINQSIWRSNFRILWLSQFIAIAGLTVLVPLLPIYMASLQNLSVVEIQLWSGIAIAAPAVTTMIASPIWGKLGDKISRKWMVLRALLGLAVCLFLMALCTTPLQFVLVRLLQGLFGGVVDASSAFASAEAPAEDRGKVLGRLQSSVSAGSLVGPLIGGVTASILGFSALLMSIAVITFIVCIFGALKLIETTHMPKSQTPNINKGIRRSFQCLLCTQQTCRFIIVGVLANFAMYGMLTALSPLASSVNHTAIDDRSVIGFLQSAFWTASILSAPLWGRFNDKSYVKSVYIFATIACGCSAILQGLATNIEFLMAARILQGLTYSALIQSVMFVVVNACHQQLKGTFVGTTNSMLVVGQIIGSLSGAAITSYTTPATTFIVMGVVFAVSSLFLICSTITNQINDHTLMKLWELKQKSAK

SEQ ID NO: 348 - protein, 185 aa, Staphylococcus aureus
MKRLFDVVSSIYGLVVLSPILLITALLIKMESPGPAIFKQKRPTINNELFNIYKFRSMKIDTPNVATDLMDSTSYITKTGKVIRKTSIDELPQLLNVLKGEMSIVGPRPALYNQYELIEKRTKANVHTIRPGVTGLAQVMGRDDITDDQKVAYDHYYLTHQSMMLDMYIIYKTIKNIVTSEGVHH

SEQ ID NO: 349 - protein, 387 aa, Staphylococcus aureus
MAQLNSKIASLKLFASYAIATYILVILTSALNLFKGYVADTFYIAETLLIVLTIILIIILTTEQTWKHHDLWRRIVEVLLLLMTLTGNVFTLLMFVSIRRYQRTSQIHSYNGWESFIRKTTRHRIAIIGLLILVYMLTLSIVSQFTFDTTLATKNQFNALLHGPSLAYPFGTDDFGRDLFTRVVVGTKLTFSISIISVVIAVIFGVLLGTIAGYFNHIDNLIMRILDVVFAIPSLLLAVAIIASFGASIPNLIIALSIGNIPSFARTMRASVLEIKRMEYVDAARITGENTWNIIWRYILPNAIAPMIVRFSLNIGVVVLTTSSLSFLGLGVAPDVAEWGNILRTGSNYLETHSNLAIVPGVCIMFVVLAFNFIGDAVRDALDPRIH

SEQ ID NO: 350 - protein, 388 aa, Staphylococcus aureus
MKTIHLFRIYHSFLLKKWYLIIYLLFILAALLITLTTIQHVTEDDNHFNIGVVDKDQSSETKLILNSIGKGSNLGKNVSIKAYDDKQAHTLLKKHKLQGYFVFDKGMTKAFYKQGELPISVYTYDQQSMKSVVLSQLTDSVYQRLMRSMGGILAFQDLAPKASHSDSINVMTDLLITGLNRSGAFNLEPIHLYDTGSYYAITGFLTTVFIFALSLFTVLKMNQDTVLKARLKMFHFSKERLLIIRTLITWFYTMLWSIVGVVWIVFSIPNIFELYNWPTLAIHLSYYVTFLILWLLLIELLTTGLLNSISKVILAIVILVLSGLTIPTIFLQHIANGVFNIQPFAVVTNQLLEIILNNYILELHPSFYLSFIALLIINLAVLVWRYRQ

SEQ ID NO: 351 - protein, 435 aa, Staphylococcus aureus
MKKQVIISGLMLFSLFFGAGNLIFPPMLGHTAGQNMWIGMLGFALTGILLPFITVIVVAFYDEGVESVGNRIHPWFGFIFAVVIYMSIGAFYGIPRAANVAYEIGTRHILPVHNQWTLIIFAAIFFAIVYWISLNPSKIVDNLGKLLTPLLLLMVALLSIAVIFNPESALSAPKDKYITHPFISGSLEGYFTMDLVAALAFSVVIVNGYKFKGLTDRMKILKYVCFSGLIAAILLGMIYFALAYVGASTAPGNFKDGTDILTYNSLRLFGSFGNLVFGMTVILACLTTCIGLVNACATFTKKHVPKFSYKIFALIFSIIGFLFTTLGLEMILKIAVPLLTLIYPVSIALVLISFANMFSTFRFSWAYRLATVITLIISILQILNSFNLLHGVILKSFMMLPLADIDLAWLVPFMLFAIIGFIIDVFIRRPKQATT

SEQ ID NO: 352 - protein, 570 aa, Staphylococcus aureus
MKHYLTKFVAMLITAAMVCSFGLLKSQAAEQQSISDVYSVITDAKSALSNNSISNDNKQKAIEQVVSAVKKLSLEDNSESNAVKSDVRKLEDAKANDNQKDTLSQLTKSLIAYEEKLASKDAGSKIKLLQQQVDAKDAAMTKAIKDKNKAELESLNNSLNQIWTSNETVIRNYDANQYGQIEVALLQLRIAIHKSPLDTAKVSHAWTTFKSNIDHVDKKSNTSANDQYHVSQLNDALEKAIKAIDDNQLSDADAALTHFIETWPYVEGQIQTKDGALYTKIEDKIPYYQSVLDEHNKAHVKDGLVDLNNQIKEVVGHSYSFVDVMIIFLREGLEVLLIVMTLTTMTRNVKDKKGTASVIGGAIAGLVLSIILAITFVETLGNSGILRESMEAGLGIVAVILMFIVGVWMHKRSNAKRWNDMIKNMYANAISNGNLVLLATIGLISVLREGVEVIIFYMGMIGELATKDFIIGIALAIVILIIFALLFRFIVKLIPIFYIFRVLSIFIFIMGFKMLGVSIQKLQLLGAMPRHVIEGFPTINWLGFYPSYEPLIAQGAYIMVVAILIFKFKK

SEQ ID NO: 353 - DNA, 1521 bp, Staphylococcus epidermidis
atgaagaatttttctaaattcgcacttacaagtattgccgcattaactgtggcaagtcctttagtcaatacggaggttgacgctaaggataaagtatcagcaactcaaaacatcgatgcgaaagtaacccaagaatctcaagcaactaacgcattgaaagagttaccaaaatctgaaaatataaaaaagcattacaaagattataaggtcactgatactgaaaaagataacaaaggatttacgcattacacattgcaaccgaaagtgggcaacacgtatgcaccagacaaagaagtaaaagttcatacgaataaagagggtaaggtagttcttgtcaatggtgatactgatgctaagaaagttcaacctacgaataaggtagcgataagtaaagaaagtgccacagataaagctttcgaagcaataaaaattgaccgtcaaaaagctaaaaacttaaaaagtgatgtcatcaaaaccaataaagttgagattgatggagaaaaaaataaatatgtttataacatagaaattattacaacttcaccaaaaatctctcattggaatgtgaaaattgacgctgaaactggtcaagtggttgataaattaaatatgatcaaagaagcagctactacaggtacaggtaaaggtgtactaggtgacacgaaacaaattaatattaatagtgtcagcggtggttatacactacaagatttaactcaacaaggtacactttcagcttacaattacgatgcgaatactggtcaagcttacttaatgcaagataaagataaaaattttgttgatgatgaacaacgtgcaggtgtagatgcaaattattatgctaaagaaacgtatgactattataaaaatactttcggccgagaatcatatgataatcaaggtagcccaattatttcaatcgcacatgtaaataacttccaaggtcaagataacagaaacaatgcagcttggattggtgataaaatgatttacggtgacggtgatggacgtacatttacagcgttgtctggtgcgaatgatgttgttgcacatgaaattacacatggtgtaacacagcaaactgctaatcttgtttaccgttctcaatcaggtgcattaaatgaaagtttttcagatgtatttggttacttcattgatgatgaagatttcttaatgggtgaagatgtttacacacctggtgtaggcggagatgccttaagaagtatgtctaatccagagcgttttggacaaccatctcatatgaatgattttgtttatacaaattctgacaacggaggcgtacatacgaattcaggtattccgaacaaagcagcttacaacacaattcgtagtattggtaaacaacgttctgaacaaatttattatagagcgttaactgtttatttaacttcaaattctgatttccaagatgccaaagcatcattacaacaagcagcatttgatttatatggcgacggtattgctcaacaagtaggtcaagcatgggacagtgttggcgtg

SEQ ID NO: 354 - DNA, 384 bp, Staphylococcus epidermidis
atgtctaaacatagtgctacgttagttattatgtttttaataactttattgcctatttttcaatatcaagcttctgcacatgcgactttagaaaaatcaacaccacaacagcaaggggttattaaagacaaaccagaagcaatcaagttagagtttaatgaacctgtgaacaccaaatactcgagtgtgaccttatttgatgataaaggtaaaaagattaaagaccttaaaccaataacaactggatggtctcagacagttgtattttcatctgagcaaattgttaatggcacgaatactattgaatggcatacggtatctgcggatggacatgaagtcggagatacgtttgaattttcagttggaaaagtgaggctaaagatg

SEQ ID NO: 355 - DNA, 471 bp, Staphylococcus epidermidis
atgaaaaaaatcaaaacaatctcgacattggtagctggacttggtatagcatttctaggtcacacaacacatgcagatgcggctgaaaataacaatcaacaacaaagtacatataactatagtacaactgaagtatcattttctaattcaggaaatttatatacttctggccaatgtacttggtatgtttatgataaaactggtggaaaaatcggatcaacatgggggaatgcaaatagctgggcaactgcagctcaagcagcaggattcactgtaaataatacacctgaagaaggtgcaattatgcaatcatctgaaggtgctttcggacatgttgctttcgttgaaagtgtcaataatgatggttctattactgtatcagaaatgaactatgatggtggtccattcgctataagcacacgaacaatctctgccagtgaagcaagttcatataattacatccacctgaat

SEQ ID NO: 356 - DNA, 771 bp, Staphylococcus epidermidis
atgaaaaaaatcgctacagctacaattgcaactgcaggaatcgctactttcgcatttgcacaccatgacgcacaagcagcagaacaaaataatgatgggtacaatccaaacgacccttattcatatagctacacttacacaatcgatgctgaaggtaactaccactacacttggaaaggtaactggagtccagatcgtgtaaatacttcatataactataataattataataactacaactactatggttacaataactatagcaactacaataactacagtaattacaacaattacaacaactatcaatcaaacaacacgcaatcacaaagaacaactcaaccgactggtggtttaggcgcaagctattcaacatcaagtagtaatgttcacgttacaacaacttctgcgccatcatcaaacggtgtatctttatcaaacgctcgctcagcatctggtaacttatacacttcaggtcaatgtacatattatgtatttgacagagtaggtggcaaaatcggttcaacgtggggtaacgcaaacaactgggcaaacgctgcagcacgttctggttacacagtaaacaattcacctgctaaaggtgcaatcttacaaacgtcacaaggtgcatacggacacgtagcatacgttgaaggtgtaaacagcaatggttcaatcagagtttcagaaatgaactacggtcacggtgcaggtgttgtcacttcacgtacaatctctgcgagtcaagctgcttcatataactatattcac

SEQ ID NO: 357 - DNA, 1560 bp, Staphylococcus epidermidis
ttggaagataaaaaagctccagtaaatgaagactttttaaattacatcaaaaactatgccgatgtaagaaacatacctctttcaagacgtaagatggcctcgttgtttcacacttctaaaactgcaattgatgatgtctcacaagaaaaactaaatacttggttacgaaaacctgataagttttacgtgaatattatcgagctttcgaaagacttatattacaagtctggtgaatatcgtagcttacttaattactttattgatatggctcgtttctattatgtgattgatccattgtttagcagcgatagtaagatgagcaaggagaaagtcaaaaaagacctctctaaaatatctttacaacttaataaaatgaatttaaaacatgagttagctaaaatttacaaaacatgtgtacttgaagatattttctttggttatgaaatcgaagataaagacaattacttcatgttaaaacttgatccaaagtattgtaaattagttggtatctctgacgggatgtatacatatgctttcaacctgtcctattttgacggtaatttagatttattaaaaacattcccagaagagtttcaaagagcatatttagaacgctctattgataagcaagctgacttaaattggtttattccagacttcactaaatcagttgttttcaaaattaatgaagacgatcctactattttacctccattttctacaatgtttgaacccctattagatttaaacgattataaaaagcttaaaaaagctggagctaaaattaataactacatgttattacatcaaaaagtgccaatgcatgataatgcaaataaagattatcaagctgataacttcgcaatctcagctgaggcaatggactacttcagcgagttagttaacgaaaacttaccagatgaaattggttctatcgtttcccctatggaagttaaccctattaaattagatagagatgataaaactgataaggtacttgaagctactagagatgtttataacgcttctggtgtttcttcatttatctttaacaatgataaaaactctactggtggtttaacttactcagttcgtaaagatgagttattcgtaattaatttctaccgacaagttgagagatggttaaatcgtaaaatcagatatggcaatatcgtagccaaaaatcaatggagaatttctctattaaatgtaactggaatgagtgaagatacttacttagagcaattaactaagtctggtacattcggtttctcagttagaggacgtattgctgcattacatggtttagattaccatacattatctcaaagtttagaattagaaaacaatatcttagatttagatactaatttaatacctcttgctagttctcatactggtggtttaaatactgctgttgaacaaacaaaaggaaaaatagaagactctggtggcagacctactaaagaaactaaagacttgtctgatagcggacaagcaaatcgtgactctagtaattctgagacaaaatctttagaaggtggtgacactaataatgaa

SEQ ID NO: 358 - DNA, 1881 bp, Staphylococcus epidermidis
gtgggagtcgtgtcaatcattactgggattacaatatttgtcagtggtcagcatgctcaagctgctgaaatgacacaatcatcatcagattctaacgaacagtcacaacaaacagaacaagttgaacacaaagaagatacaactcatttatcttacgaattgaatcaagagggtgagacagcgagccaatcaaagactagtcaagagaatcaatctgatggcaatgtacaaaaaaagagtaatcaaatacaacaagattcaacacaaacgtcaccattaaatgaccaaaaacaaacttcaatggaacaacaatcaaaagacaatcatgttaccccaaattcacgtcaggatacatatccaaaaggccaaaatcaagatgataaaggcaaacaacagtttaaagataatcaacactcacaaacagaacatcaacctaatactcaaaaccaaaataatgatcaagattcatcagataaaaagcaacacccatctgatcaaactcaagactcatcttcaaaaggaacacaacctaaacaatcacagtctatagaagatagagataaaacagtaaaacaaccatcttctaaagtacacaaaataggtaacacaaaaactgataaaacagttaaaacaaatcaaaaaaagcaaacatcattaacttcaccacgcgttgtgaaatcaaaacaaactaaacatatcaatcaacttactgcgcaagctcaatataaaaatcaatatccagtcgtgtttgtacatggatttgtaggtttagtcggtgaagatgcattcagcatgtacccaaattattggggtggtactaaatataacgtgaaacaagaacttacaaaattaggttaccgagttcacgaagccaatgtaggggcatttagcagcaattatgaccgtgctgttgaactgtattattatattaaaggtggaagagtagattatggtgcagcacatgctgcaaaatatggtcacaagcgttatggcagaacatatgaaggcatcatgcctgattgggaaccaggtaaaaagatacatcttgttggacatagtatgggtggccaaacgatacgcttgatggaacattttttaagaaatggaaatcaagaagaaatagattatcaacgtcaatatggtggtacggtatccgatttatttaaaggtggacaagataatatggtgtctacgattactacattaggaacgcctcataatggcacacctgctgcagataaactagggtcgactaaatttattaaagatacaattaatagaattggaaaaattggtggaactaaagcgctcgatttagaactaggtttttctcaatggggcttcaaacagcaacctaatgaatcatatgctgaatatgcaaaacgtatagcgaatagtaaagtttgggagactgaagatcaggctgtaaatgatttaacaactgctggagcagaaaagttaaaccaaatgacgacattgaatcctaatatcgtctatacatcatatacaggtgctgcaacacatactggaccattaggcaatgaagtgccgaatattagacaattcccactattcgatttaacaagtcgtgtgataggtggagatgataataaaaatgtcagagtaaatgatggcatagtacctgtgtcttcttcactacatccaagtgatgaagcatttaagaaggtaggtatgatgaacctagcaactgacaagggtatctggcaagtgagacccgtacaatatgattgggatcatctagatttagtcggcttagatactactgattataagcgaactggagaagaattaggtcaattctatatgagtatgataaataatatgttgaaagtcgaagagttagatggtattacacgtaag

SEQ ID NO: 359 - protein, 507 aa, Staphylococcus epidermidis
MKNFSKFALTSIAALTVASPLVNTEVDAKDKVSATQNIDAKVTQESQATNALKELPKSENIKKHYKDYKVTDTEKDNKGFTHYTLQPKVGNTYAPDKEVKVHTNKEGKVVLVNGDTDAKKVQPTNKVAISKESATDKAFEAIKIDRQKAKNLKSDVIKTNKVEIDGEKNKYVYNIEIITTSPKISHWNVKIDAETGQVVDKLNMIKEAATTGTGKGVLGDTKQININSVSGGYTLQDLTQQGTLSAYNYDANTGQAYLMQDKDKNFVDDEQRAGVDANYYAKETYDYYKNTFGRESYDNQGSPIISIAHVNNFQGQDNRNNAAWIGDKMIYGDGDGRTFTALSGANDVVAHEITHGVTQQTANLVYRSQSGALNESFSDVFGYFIDDEDFLMGEDVYTPGVGGDALRSMSNPERFGQPSHMNDFVYTNSDNGGVHTNSGIPNKAAYNTIRSIGKQRSEQIYYRALTVYLTSNSDFQDAKASLQQAAFDLYGDGIAQQVGQAWDSVGV

SEQ ID NO: 360 - protein, 128 aa, Staphylococcus epidermidis
MSKHSATLVIMFLITLLPIFQYQASAHATLEKSTPQQQGVIKDKPEAIKLEFNEPVNTKYSSVTLFDDKGKKIKDLKPITTGWSQTVVFSSEQIVNGTNTIEWHTVSADGHEVGDTFEFSVGKVRLKM

SEQ ID NO: 361 - protein, 157 aa, Staphylococcus epidermidis
MKKIKTISTLVAGLGIAFLGHTTHADAAENNNQQQSTYNYSTTEVSFSNSGNLYTSGQCTWYVYDKTGGKIGSTWGNANSWATAAQAAGFTVNNTPEEGAIMQSSEGAFGHVAFVESVNNDGSITVSEMNYDGGPFAISTRTISASEASSYNYIHLN

SEQ ID NO: 362 - protein, 257 aa, Staphylococcus epidermidis
MKKIATATIATAGIATFAFAHHDAQAAEQNNDGYNPNDPYSYSYTYTIDAEGNYHYTWKGNWSPDRVNTSYNYNNYNNYNYYGYNNYSNYNNYSNYNNYNNYQSNNTQSQRTTQPTGGLGASYSTSSSNVHVTTTSAPSSNGVSLSNARSASGNLYTSGQCTYYVFDRVGGKIGSTWGNANNWANAAARSGYTVNNSPAKGAILQTSQGAYGHVAYVEGVNSNGSIRVSEMNYGHGAGVVTSRTISASQAASYNYIH

SEQ ID NO: 363 - protein, 520 aa, Staphylococcus epidermidis
LEDKKAPVNEDFLNYIKNYADVRNIPLSRRKMASLFHTSKTAIDDVSQEKLNTWLRKPDKFYVNIIELSKDLYYKSGEYRSLLNYFIDMARFYYVIDPLFSSDSKMSKEKVKKDLSKISLQLNKMNLKHELAKIYKTCVLEDIFFGYEIEDKDNYFMLKLDPKYCKLVGISDGMYTYAFNLSYFDGNLDLLKTFPEEFQRAYLERSIDKQADLNWFIPDFTKSVVFKINEDDPTILPPFSTMFEPLLDLNDYKKLKKAGAKINNYMLLHQKVPMHDNANKDYQADNFAISAEAMDYFSELVNENLPDEIGSIVSPMEVNPIKLDRDDKTDKVLEATRDVYNASGVSSFIFNNDKNSTGGLTYSVRKDELFVINFYRQVERWLNRKIRYGNIVAKNQWRISLLNVTGMSEDTYLEQLTKSGTFGFSVRGRIAALHGLDYHTLSQSLELENNILDLDTNLIPLASSHTGGLNTAVEQTKGKIEDSGGRPTKETKDLSDSGQANRDSSNSETKSLEGGDTNNE

SEQ ID NO: 364 - protein, 627 aa, Staphylococcus epidermidis
VGVVSIITGITIFVSGQHAQAAEMTQSSSDSNEQSQQTEQVEHKEDTTHLSYELNQEGETASQSKTSQENQSDGNVQKKSNQIQQDSTQTSPLNDQKQTSMEQQSKDNHVTPNSRQDTYPKGQNQDDKGKQQFKDNQHSQTEHQPNTQNQNNDQDSSDKKQHPSDQTQDSSSKGTQPKQSQSIEDRDKTVKQPSSKVHKIGNTKTDKTVKTNQKKQTSLTSPRVVKSKQTKHINQLTAQAQYKNQYPVVFVHGFVGLVGEDAFSMYPNYWGGTKYNVKQELTKLGYRVHEANVGAFSSNYDRAVELYYYIKGGRVDYGAAHAAKYGHKRYGRTYEGIMPDWEPGKKIHLVGHSMGGQTIRLMEHFLRNGNQEEIDYQRQYGGTVSDLFKGGQDNMVSTITTLGTPHNGTPAADKLGSTKFIKDTINRIGKIGGTKALDLELGFSQWGFKQQPNESYAEYAKRIANSKVWETEDQAVNDLTTAGAEKLNQMTTLNPNIVYTSYTGAATHTGPLGNEVPNIRQFPLFDLTSRVIGGDDNKNVRVNDGIVPVSSSLHPSDEAFKKVGMMNLATDKGIWQVRPVQYDWDHLDLVGLDTTDYKRTGEELGQFYMSMINNMLKVEELDGITRK

SEQ ID NO: 365 - DNA, 270 bp, Staphylococcus aureus
tcaataaggtgctttctaaagaatttttctccccatgtccaatctataaataaatctttggttaaaaattgcgacacaaccattctcattcgattatgcataaaaccagtttgtgtcaattccattattgctgcatcaatgattggaaatcctgtttgcccttcgcaccatgcattaaaatccgcttcattttgcgaccattttatctgtcgatatttaggtttgaaagcttggtatgaggtttcaggatactgtgtcattaacacataa

SEQ ID NO: 366 - DNA, 201 bp, Staphylococcus aureus
ctgttgcaccatttggtccttttgcacctaagtcaattgatacttgcccagttgccatatcaggaattaacattggtacgaaaaatggactcacacgtcttgggcctttatccattaattgtttatgtgcaatttcaaatgtttccataccaccgataccagaaccaatccatacaccgattcgatctgcagtattttcat

SEQ ID NO: 367 - DNA, 132 bp, Staphylococcus aureus
gatgcacctttaggtctaatacctggtgttacttttaaaaatgatgtacctaacttttcagtcaacatacgactttcaagaggtgaacaaacaacgccatctaaaccagctgcatttgctaacttggcataa

SEQ ID NO: 368 - DNA, 231 bp, Staphylococcus aureus
tacatcaaaccactatgtttacccattttcttaccatcaagtgttatcatatcacccggttgtgcaggtaaatattgtgataaaaatgttttaaagtttttttcgccgataaaacaaatgcctgtagaatcttttttcttagcagtaacaagtccttgttcttcagcaattcgacgcacttcactcttttcgatgtcgccaattgggaacatcacttttgaaagttgttgt

SEQ ID NO: 369 - DNA, 285 bp, Staphylococcus aureus
cgtttcgcatcttcatcatattctaataatggccaatctgtcacccataagaagtttaattttgtttcatcgattaaacctaattctttagctaatttgacacgtaatgcacctaaactttgtgcaacgacatttggtttgtctgcaacaaacattactaagtcaccagcttcagcaccagttaatgtaagtaatgtttcaacattttctgtttcaaagaaacgtccaattggacctgtcaaaccatcttccacaactttaacccacgctaatcctttagcacca

SEQ ID NO: 370 - DNA, 99 bp, Staphylococcus aureus
cgtcaacgtcctgtccatgtgtttccaaaaaataataatccacatgggcaatataatcatcaatatcaacatcactacgtaacgctagcaaatgctttt

SEQ ID NO: 371 - DNA, 123 bp, Staphylococcus aureus
atgaatgaagcatctaatttaatcttaaccatgccaaatgaatccaaagccgcaactaaaatagcaaagattaagccgccaatcactggtgctggtatacaaatacgttttaaaaaattaacg

SEQ ID NO: 372 - DNA, 213 bp, Staphylococcus aureus
attctatcagccgcattatccacaccggcattattaaacaacacatcgattcttccaaactgttcctttatgtcagacacaaagtctaccacttgttgttcgcttgcattatccacattatacgccttcgcattgtcaccattacttttaattttatcgacagtctccgataccgcttcagctatgtctaccgccaatacatacgcaccttat

SEQ ID NO: 373 - DNA, 327 bp, Staphylococcus aureus
cctggcgctattgtttcaggtccgtattctgttaattcattaatcggatcttttgtaatctcttcttttggttcacctttactaataattactccagttaatggattttttagtgttggtgtcgttattgtcttctcacctttttgtccttctcttgttactttttctgtccctggtgctaaatccggattaaatttacgttctttcttgaatggaatctcttcaacttttttttctaattctgttattgtttttggcgcttctggtgtaaaagtaaactctgaacctttcaagtcagttctcatccagccatttgcatttatccct

SEQ ID NO: 374 - DNA, 348 bp, Staphylococcus aureus
ttactaacatttattgctgttaaacctacgatgacaaataaaataatagctaatacttttaaaataactaaaatattttccatacgagctgcttccgacataccacgtgatagtaataatgcagttaataaaataacgatagcagcaataatatcgataaaaccgccatttgtaccaaatggatttgataatgctgcaggtaattcgatgccaattggtttcacaagtccgcgtaaattcgctgagaatcctgatgcaacaaaggctacggcgataaaatattcagctaatagagcccaaccggcaacccatccaaaaaattcaccaaataatacattgacccaagaa

SEQ ID NO: 375 - DNA, 219 bp, Staphylococcus aureus
gatgtgttgaaactgagttcaattaaattatatgtttttattatacactttttgacatattttttaaatttaagaatgcgaagatttttaacatttctgatgctagctttctttttcatctttcaaatgcttaataaaatcaaagccaggtcgccctttagccaatgcttccatcacatcataccaatccgaaccgacttgttgatatatattttgcaa

SEQ ID NO: 376 - DNA, 258 bp, Staphylococcus aureus
tctatcattgtaaatactgtatctaagtgcataaaagttcgactagttggaatttcaattgctactacttttttaaacgtcgcctgcggattttcaaaaatacgtcgcgctaacttttcaatagcttgtgcagatgtacgttctgaaacgcctatagccaagacatctttagataaaacaagttcatcgccgccttcaatattgaatgggcaatctcgatctaaccagattggaatattcgcatctttaaatctagga

SEQ ID NO: 377 - DNA, 135 bp, Staphylococcus aureus
gaagtcttggccattcccttgagtaaacatgaagccccagccatctgctcctgttgtattaccttggttgttgtttgctactggaacagtaattgtaaagtctttattaaaatctattttatcattatattctaa

SEQ ID NO: 378 - protein, 89 aa, Staphylococcus aureus
SIRCFLKNFSPHVQSINKSLVKNCDTTILIRLCIKPVCVNSIIAASMIGNPVCPSHHALKSASFCDHFICRYLGLKAWYEVSGYCVINT

SEQ ID NO: 379 - protein, 67 aa, Staphylococcus aureus
LLHHLVLLHLSQLILAQLPYQELTLVRKMDSHVLGLYPLIVYVQFQMFPYHRYQNQSIHRFDLQYFH

SEQ ID NO: 380 - protein, 43 aa, Staphylococcus aureus
DAPLGLIPGVTFKNDVPNFSVNIRLSRGEQTTPSKPAAFANLA

SEQ ID NO: 381 - protein, 77 aa, Staphylococcus aureus
YIKPLCLPIFLPSSVIISPGCAGKYCDKNVLKFFSPIKQMPVESFFLAVTSPCSSAIRRTSLFSMSPIGNITFESCC

SEQ ID NO: 382 - protein, 95 aa, Staphylococcus aureus
RFASSSYSNNGQSVTHKKFNFVSSIKPNSLANLTRNAPKLCATTFGLSATNITKSPASAPVNVSNVSTFSVSKKRPIGPVKPSSTTLTHANPLAP

SEQ ID NO: 383 - protein, 33 aa, Staphylococcus aureus
RQRPVHVFPKNNNPHGQYNHQYQHHYVTLANAF

SEQ ID NO: 384 - protein, 41 aa, Staphylococcus aureus
MNEASNLILTMPNESKAATKIAKIKPPITGAGIQIRFKKLT

SEQ ID NO: 385 - protein, 71 aa, Staphylococcus aureus
ILSAALSTPALLNNTSILPNCSFMSDTKSTTCCSLALSTLYAFALSPLLLILSTVSDTASAMSTANTYAPY

SEQ ID NO: 386 - protein, 109 aa, Staphylococcus aureus
PGAIVSGPYSVNSLIGSFVISSFGSPLLIITPVNGFFSVGVVIVFSPFCPSLVTFSVPGAKSGLNLRSFLNGISSTFFSNSVIVFGASGVKVNSEPFKSVLIQPFAFIP

SEQ ID NO: 387 - protein, 116 aa, Staphylococcus aureus
LLTFIAVKPTMTNKIIANTFKITKIFSIRAASDIPRDSNNAVNKITIAAIISIKPPFVPNGFDNAAGNSMPIGFTSPRKFAENPDATKATAIKYSANRAQPATHPKNSPNNTLTQE

SEQ ID NO: 388 - protein, 73 aa, Staphylococcus aureus
DVLKLSSIKLYVFIIHFLTYFLNLRMRRFLTFLMLAFFFIFQMLNKIKARSPFSQCFHHIIPIRTDLLIYILQ

SEQ ID NO: 389 - protein, 86 aa, Staphylococcus aureus
SIIVNTVSKCIKVRLVGISIATTFLNVACGFSKIRRANFSIACADVRSETPIAKTSLDKTSSSPPSILNGQSRSNQIGIFASLNLG

SEQ ID NO: 390 - protein, 44 aa, Staphylococcus aureus
EVLAIPLSKHEAPAICSCCITLVVVCYWNSNCKVFIKIYFIIIF

SEQ ID NO: 391 - DNA, 162 bp, Staphylococcus aureus
cgttgcacaaagctgaatgttaaaaatgcggatccgccagcaatgactgcaatccaacaatctgatgcgacaccaccaaacataaataggaagaagccacatgcaatggcagctgcaaagaaattcgttaaaaaagaatattgtaatgatgcatgctgtaaa

SEQ ID NO: 392 - protein, 54 aa, Staphylococcus aureus
RCTKLNVKNADPPAMTAIQQSDATPPNINRKKPHAMAAAKKFVKKEYCNDACCK

SEQ ID NO: 393 - DNA, 1845 bp, Staphylococcus aureus
atgactaataaaagagaagatgtccgcaatatagcaattattgctcacgttgaccatggtaaaacaactttagtagatgagttgttaaaacaatctggtatattcagagaaaatgaacatgtcgatgaacgtgcaatggactctaacgatatcgaaagagagcgtggaattacgattctagccaaaaatacggctgttgattataaaggtacacgtattaatattttggatacaccaggacatgcagactttggtggagaagtagaacgtattatgaaaatggttgatggggttgtcttagtagtagatgcgtatgaaggtacaatgcctcaaacacgttttgtacttaaaaaagcgctagaacaaaacctgaaacctgttgttgttgttaataaaattgataaaccatcagcacgtccagagggtgttgtagatgaagttttagatttatttattgaattagaagcaaacgatgaacaattagaattccctgttgtttatgcttcagcagtaaatggtacagctagcttagatcctgaaaagcaagatgataatttacaatcattatatgaaacaattattgattatgtaccagctccaattgataacagtgatgagccattacaattccaagtagcattgttggactacaatgattatgttggacgtattggtattggtcgtgtattcagaggtaaaatgcgtgtcggagataatgtatcactaattaaattagacggtacagtgaaaaacttccgtgtaactaaaatctttggttactttggattaaaacgtttagaaattgaagaagcacaagctggagatttaattgctgtttcaggtatggaagacattaatgttggtgaaactgtaacaccacatgaccatcaagaagcattgccagttctacgtattgatgagcctactcttgaaatgacatttaaagttaacaattctccatttgctggccgtgaaggtgactttgtaacagcacgtcaaattcaagaacgtttaaatcaacaattagaaacagatgtatctttgaaagtttctaacacagattctccagatacatgggtagttgctggtcgcggtgaattgcatttatcaatccttattgaaaatatgcgtcgtgaaggttatgaattacaagtttcaaaaccacaagtaattattaaagaaatagatggtgtaatgtgtgaaccatttgaacgtgtgcaatgtgaagtgccacaagaaaatgcaggtgctgttattgaatcattaggtgcacgtaaaggtgaaatggttgatatgactacaactgataatggacttacacgtttaatctttaatgtaccggctcgtggtatgattggttatacgactgaatttatgtcaatgacaagaggttacggtattattaaccatacatttgaagaatttagaccacgtattaaagcacaaattggcggtcgtcgtaatggtgcattaatttcaatggatcaaggttctgcaagtacttatgccattttgggacttgaagatagaggtgtaaacttcatggaacctggtactgaagtttatgaaggtatgattgttggtgaacataatcgtgaaaatgatttaactgttaacatcactaaaacaaaacatcaaactaacgtacgttctgcaacgaaagaccaaacacaaacaatgaatagaccgcgtattctaacattggaagaagcgttacaattcattaatgatgatgaacttgttgtggttacaccagaaagtatacgtttaagaaagaaaattttaaacaaaaatgttcgtgaaaaagaagcaaagcgtatcaaacaaatgatgcaagaaaacgaa

SEQ ID NO: 394 - DNA, 1260 bp, Staphylococcus aureus
gtgcttaggagtgatttttatatgtcttattccattgttagagtttcaaaagttaaatctggaacaaatacaacgggcatacaaaaacatgttcaaagagaaaataataattatgaaaatgaagatatagaccatagtaaaacttacttaaattatgatttggtaaatgctaataaacagaattttaataacttgattgatgaaaaaatcgaacagaattatacaggcaaaagaaaaattagaacagacgcgattaaacacattgatggtttaattacatcagacaatgatttctttgataatcaaacgccagaagatacaaagcagttttttgaatatgctaaagagtttttagaacaagaatacggtaaagataatttattatatgcaacagttcacatggacgaaaaaacaccacatatgcattatggcgttgttccaataactgatgatggtcgtttaagtgctaaagaagttgtaggtaataaaaaagctttaacagcgtttcaagatagatttaatgagcatgttaaacaacgaggatatgatttagaacgtgggcaatcaagacaagtaacaaatgctaaacatgagcaaataagtcagtataaacaaaaaacagaatatcataagcaagaatatgaacgtgagagccaaaaaacagaccatataaagcaaaagaacgataaattaatgcaagagtaccaaaaatcgttaaatacgcttaaaaagcctataaatgttccgtatgagcaagaaactgaaaaagtaggtggtttatttagcaaagaaatacaagaaactggaaatgttgtaataagccaaaaagatttcaatgaatttcagaaacagataaaagctgctcaagatatttcggaagattacgagtatataaagtctggtagagccttagatgataaagataaggaaatacgagagaaagatgatttattaaataaagcagttgagcgtattgaaaacgcagacgataattttaaccaactttacgaaaatgcaaagccacttaaagagaatatagaaatagcgttaaagcttttaaaaatcttactaaaagagttagaacgagttttaggaagaaatacctttgcggaaagagttaataagttaacagaagatgaaccaaaacttaatggtttagcaggaaacttagataaaaaaatgaatccagaattatattcagaacaggaacagcaacaagaacaacaaaagaatcaaaaacgagatagaggtatgcactta

SEQ ID NO: 395 - protein, 615 aa, Staphylococcus aureus
MTNKREDVRNIAIIAHVDHGKTTLVDELLKQSGIFRENEHVDERAMDSNDIERERGITILAKNTAVDYKGTRINILDTPGHADFGGEVERIMKMVDGVVLVVDAYEGTMPQTRFVLKKALEQNLKPVVVVNKIDKPSARPEGVVDEVLDLFIELEANDEQLEFPVVYASAVNGTASLDPEKQDDNLQSLYETIIDYVPAPIDNSDEPLQFQVALLDYNDYVGRIGIGRVFRGKMRVGDNVSLIKLDGTVKNFRVTKIFGYFGLKRLEIEEAQAGDLIAVSGMEDINVGETVTPHDHQEALPVLRIDEPTLEMTFKVNNSPFAGREGDFVTARQIQERLNQQLETDVSLKVSNTDSPDTWVVAGRGELHLSILIENMRREGYELQVSKPQVIIKEIDGVMCEPFERVQCEVPQENAGAVIESLGARKGEMVDMTTTDNGLTRLIFNVPARGMIGYTTEFMSMTRGYGIINHTFEEFRPRIKAQIGGRRNGALISMDQGSASTYAILGLEDRGVNFMEPGTEVYEGMIVGEHNRENDLTVNITKTKHQTNVRSATKDQTQTMNRPRILTLEEALQFINDDELVVVTPESIRLRKKILNKNVREKEAKRIKQMMQENE

SEQ ID NO: 396 - protein, 420 aa, Staphylococcus aureus
VLRSDFYMSYSIVRVSKVKSGTNTTGIQKHVQRENNNYENEDIDHSKTYLNYDLVNANKQNFNNLIDEKIEQNYTGKRKIRTDAIKHIDGLITSDNDFFDNQTPEDTKQFFEYAKEFLEQEYGKDNLLYATVHMDEKTPHMHYGVVPITDDGRLSAKEVVGNKKALTAFQDRFNEHVKQRGYDLERGQSRQVTNAKHEQISQYKQKTEYHKQEYERESQKTDHIKQKNDKLMQEYQKSLNTLKKPINVPYEQETEKVGGLFSKEIQETGNVVISQKDFNEFQKQIKAAQDISEDYEYIKSGRALDDKDKEIREKDDLLNKAVERIENADDNFNQLYENAKPLKENIEIALKLLKILLKELERVLGRNTFAERVNKLTEDEPKLNGLAGNLDKKMNPELYSEQEQQQEQQKNQKRDRGMHL

SEQ ID NO: 397 - DNA, 762 bp, Staphylococcus aureus
atgactgttgaagaaagatccaatacagccaaagttgacattttaggggtcgattttgataatacaacaatgttgcaaatggttgaaaatattaaaaccttttttgcaaatcaatcaacgaataatctttttatagtaacagccaaccctgaaatagtgaattacgcgacgacacatcaagcgtatttagagttaataaatcaagcgagctatattgttgctgatgggacaggagtagtcaaagcttcgcatcgtttaaagcaacctctagcgcatcgtatacctggtattgagttgatggatgaatgtttgaaaattgctcatgtaaatcatcaaaaagtatttttgctaggggcaactaatgaagttgtagaagcggcacaatatgcattgcaacaaagatatccaaacatatcgtttgcacatcatcacggttatattgatttagaagatgagacagtagtgaaacgaattaaactgtttaaacctgattacatatttgtaggtatgggattccctaaacaagaagaatggattatgacacatgaaaaccaatttgaatctacagtgatgatgggcgtaggtggttctcttgaagtatttgctggggctaaaaagagagcgccttatatctttagaaaattaaacattgaatggatatatagagcattaatagattggaaacgtattggtagattaaagagtattccaatatttatgtataaaatagccaaagcaaaaagaaaaataaaaaaggcgaaa

SEQ ID NO: 398 - protein, 254 aa, Staphylococcus aureus
MTVEERSNTAKVDILGVDFDNTTMLQMVENIKTFFANQSTNNLFIVTANPEIVNYATTHQAYLELINQASYIVADGTGVVKASHRLKQPLAHRIPGIELMDECLKIAHVNHQKVFLLGATNEVVEAAQYALQQRYPNISFAHHHGYIDLEDETVVKRIKLFKPDYIFVGMGFPKQEEWIMTHENQFESTVMMGVGGSLEVFAGAKKRAPYIFRKLNIEWIYRALIDWKRIGRLKSIPIFMYKIAKAKRKIKKAK

SEQ ID NO: 399 - DNA, 1506 bp, Staphylococcus aureus
atgagtgaaaattttaagttacgtaaaatgaaagtcggtttagtatctgttgcaattacaatgttatatattatgacaaacggacaagcagaagcatctgaaaatcaaaacgctttaatctctaatataaatgtagacaatcaggaaaaacagaataatgtaaatcaagctgttcagcctcaaaataatactaatgaaacatcaaaagtaccggctaattttgtcaaattgaatgatattaaaccaggtgatacttctatacaaggaacaactttaccaaatcaatttatactattaactattgataaaaaagatgtgagctcagttgaagattctgacagcagctttgttatgtctgataaagatgggaattttaagtatgacttaaatggtcgcaaaattgttcataatcaagaaattgaagtgtcttcatcagatccctatttaggtgacgatgaagaagatgaagaagtagaagaaacttcaactgaagaagttggtgctgaggaagaaagtacagaagctaaagctacatatacaacaccgcgatatgaaaaagcgtatgaaataccgaaagaacagctaaaagaaaaagatggacatcaccaagtttttatcgaacctattactgaaggttcaggtattattaaaggccatacctctgtaaaaggtaaagttgctctatctattaataataaatttattaactttgagacaaatgctaatggtggtccaaataaagaagaagcgaaatctggatcagaaggaatctggatgcctattgatgacaaaggatactttaattttgacttcaaaacgaaacgtttcgatgatttagagttaaagaaaaatgatgagatctcattaacatttgcacctgatgacgaagatgaggcattgaagtcattaattttcaaaactaaggtaacgagtttagaagatattgataaagcagaaactaaatatgaccatactaaagtggaaaaagtaaaagtattgaaagatgttaaagaagatttacatgtagatgaaatttacggaagcttatatcatacagaaaaaggtaaaggtattcttgataaagaaggtactaaagtaattaaaggtaagactaaattcgcaaatgcagttgtgaaggtagactctgaactaggtgaaggtcaagaattccctgatttgcaagtcgatgraaaaggtgaattcagctttgatgtagatcatgctggatttagattacaaaatggagaaacactaaacttcacagtagttgatcctattacaggtgaattattaagtggaaattttgtttctaaaaacatagatatttatgaatctcctgaagaaaaagcagatcgtgagtttgatgaaagaatggaaaacacacctgcatatcataaattacatggtgataaaattgtcggctacgatactaacggattcccgattacctggttttatccattaggtgaaaagaaagttgaacgtaaggcaccaaaattagaaaaa

SEQ ID NO: 400 - protein, 502 aa, Staphylococcus aureus
  MOD_RES (397): X = anything
MSENFKLRKMKVGLVSVAITMLYIMTNGQAEASENQNALISNINVDNQEKQNNVNQAVQPQNNTNETSKVPANFVKLNDIKPGDTSIQGTTLPNQFILLTIDKKDVSSVEDSDSSFVMSDKDGNFKYDLNGRKIVHNQEIEVSSSDPYLGDDEEDEEVEETSTEEVGAEEESTEAKATYTTPRYEKAYEIPKEQLKEKDGHHQVFIEPITEGSGIIKGHTSVKGKVALSINNKFINFETNANGGPNKEEAKSGSEGIWMPIDDKGYFNFDFKTKRFDDLELKKNDEISLTFAPDDEDEALKSLIFKTKVTSLEDIDKAETKYDHTKVEKVKVLKDVKEDLHVDEIYGSLYHTEKGKGILDKEGTKVIKGKTKFANAVVKVDSELGEGQEFPDLQVDXKGEFSFDVDHAGFRLQNGETLNFTVVDPITGELLSGNFVSKNIDIYESPEEKADREFDERMENTPAYHKLHGDKIVGYDTNGFPITWFYPLGEKKVERKAPKLEK

SEQ ID NO: 401 - DNA, 129 bp, Staphylococcus aureus
gtctatatgctatcaagtaccaggtttattgttaggtggtacaacaattgtaataagtccactaatatcattaatgaaagatcaagtggatcaattaaaagcgatgggaattcaagctgcttttttaaa

SEQ ID NO: 402 - protein, 43 aa, Staphylococcus aureus
VYMLSSTRFIVRWYNNCNKSTNIINERSSGSIKSDGNSSCFFK

SEQ ID NO: 403 - DNA, 387 bp, Staphylococcus aureus
tttaaatataaaaaaaacagaaaaatacctagtattatgatgcaacaaattaaaattactatactatattcatatttaacgataaataaatgggaataccttcttaacataacaccaaataagaccgtacttcctgccactggccaaaaagaattgattttagctgtcttcacaatgtttaaagtttcaaaatctttttcgctgattttgacgtacttttttggaatcagccaattaatcattgggaaaaagagtgctaaccatgtacttactaaatcaatcatcaaatattcatctttgtatttgataattctatatttgggattcttattaatattttcagtttcacaaagcaatgtctccacttcttttcaattggttttatat

SEQ ID NO: 404 - protein, 129 aa, Staphylococcus aureus
FKYKKNRKIPSIMMQQIKITILYSYLTINKWEYLLNITPNKTVLPATGQKELILAVFTMFKVSKSFSLILTYFFGISQLIIGKKSANHVLTKSIIKYSSLYLIILYLGFLLIFSVSQSNVSTSFQLVLY

SEQ ID NO: 405 - DNA, 183 bp, Staphylococcus aureus
ggaatgaaaatgatttcgatttccgatgaaatcaattgtttaatttgttgcaattgtgtagggttatgttcttttatttcttctgctaagtatattttttggatttccatttcttctaacactgtagctaagacatcaataaagcgtggtaagtttttagttacagctaggtcgatacgacga

SEQ ID NO: 406 - protein, 61 aa, Staphylococcus aureus
GMKMISISDEINCLICCNCVGLCSFISSAKYIFWISISSNTVAKTSIKRGKFLVTARSIRR

SEQ ID NO: 407 - DNA, 264 bp, Staphylococcus aureus
tttgaagctacaaaggtaccgcataatggcagcacattaattaacaatgcgctaaactttaatgaggcgctgatttgcttgtctttaaaagtcaacatagcactgataattcctaaaatagctactatacgtggaattgtcatgctcggatactgcggtatatgtaagaaagcaccaagacctgctatcacaccacatactaacgcaatatatagaaattgcttcaaatcattcactcctaaattgttattacactattacaca

SEQ ID NO: 408 - protein, 88 aa, Staphylococcus aureus
FEATKVPHNGSTLINNALNFNEALICLSLKVNIALIIPKIATIRGIVMLGYCGICKKAPRPAITPHTNAIYRNCFKSFTPKLLLHYYT

SEQ ID NO: 409 - DNA, 708 bp, Staphylococcus aureus
atgcttgctgctcgcatactattagaatctggtgcagaaggtacgcgtgtagaagataccatgacacgtattgcaaaaaaacttggttacagtgaaagtaacagctttgttacaaacactgtcatccagtttacgttacattcggaatcgtttcctagaatatttagaattacctctcgagatacaaacttaataaaaatttctcaagctaataaaatttcgcgtcaaattacaaacaatgaaatttctttagccgaagcaaaaacgcaacttgaaaaaatatatgttgctaagcgtgacagcagtcttccctttaaaggttttgctgcagcaatgattgcaatgagtttcttatatttacaaggtggtagattgattgatgttttaactgcgatattagcaggtagtctaggatacctagtcactgagattttagatcgtaagttacacgcacagtttatcccagaattcattggttcattagttattgggattatcgccgttattggacatacacttattccaacaggtgacttggcaactattatcattgcggcagtcatgcctattgttcctggtgtattaataacaaacgcaatacaagatttatttggtggacacatgttgatgttcacaacgaaatcattagaagcattggttactgcgtttggcatcggtgctggcgttggtagcgtattaattttagta

SEQ ID NO: 410 - protein, 236 aa, Staphylococcus aureus
MLAARILLESGAEGTRVEDTMTRIAKKLGYSESNSFVTNTVIQFTLHSESFPRIFRITSRDTNLIKISQANKISRQITNNEISLAEAKTQLEKIYVAKRDSSLPFKGFAAAMIAMSFLYLQGGRLIDVLTAILAGSLGYLVTEILDRKLHAQFIPEFIGSLVIGIIAVIGHTLIPTGDLATIIIAAVMPIVPGVLITNAIQDLFGGHMLMFTTKSLEALVTAFGIGAGVGSVLILV

SEQ ID NO: 411 - DNA, 948 bp, Staphylococcus aureus
atgacatttaataaagtattattgagctggatagtcatattgattataacaactagcatatatctattttggcagttgggcgatatcaatgatgtatttaaccagtctattttaatcaatgttagattaccgagattattagaagcattgttgacaggtatgatattaactgttgcaggccttatatttcaaacagttttaaataatgcattggcagatagctttacattaggattggcaagcggcgctacatttggttcaggattagcattatttttaggtttaacaacgttatggattcctgtattttcaataacatttagtttgataacattaataactgtattagtcattacgtcggtattgagccaaggctatccagttagaatcttaatattaagtggtttaatgattggtgcgttattcaattcacttctatattttttgattttattaaaacctcgcaaattaaatacaattgccaattatctgtttggtggttttggtgatgcagaatactcaaatgtatctataatagcaatcacatttatcattgcattgtttggtatatttatcattcttaatcaactaaagttattgcaattaggagaactaaaaagtcagtcactaggcttaaatgttcaattgattacatatatcgcgttatgtatagcttctatgataacggcgataaatgtcgcatatgttggcatcattggattcattggtatggtgataccgcaactcattagaaaatggcagtggaaacaatcattaggaagacaattggctttaaatattgtaactggaggacaaataatggttatggcagattttattggtagccatatattgtcaccagtacaaataccggcaagtattatcattgcattaattggtataccagtgttattttacatgctaatatctcagtcgaaacggttacac

SEQ ID NO: 412 - protein, 316 aa, Staphylococcus aureus
MTFNKVLLSWIVILIITTSIYLFWQLGDINDVFNQSILINVRLPRLLEALLTGMILTVAGLIFQTVLNNALADSFTLGLASGATFGSGLALFLGLTTLWIPVFSITFSLITLITVLVITSVLSQGYPVRILILSGLMIGALFNSLLYFLILLKPRKLNTIANYLFGGFGDAEYSNVSIIAITFIIALFGIFIILNQLKLLQLGELKSQSLGLNVQLITYIALCIASMITAINVAYVGIIGFIGMVIPQLIRKWQWKQSLGRQLALNIVTGGQIMVMADFIGSHILSPVQIPASIIIALIGIPVLFYMLISQSKRLH

SEQ ID NO: 413 - DNA, 1935 bp, Staphylococcus aureus
atgaacaaacagcaaaaagaatttaaatcattttattcaattagaaagtcatcactaggcgttgcatctgtagcaattagtacacttttattattaatgtcaaatggcgaagcacaagcagcagctgaagaaacaggtggtacaaatacagaagcacaaccaaaaactgaagcagttgcaagtccaacaacaacatctgaaaaagctccagaaactaaaccagtagctaatgctgtctcagtatctaataaagaagttgaggcccctacttctgaaacaaaagaagctaaagaagttaaagaagttaaagcccctaaggaaacaaaagaagttaaaccagcagcaaaagccactaacaatacatatcctattttgaatcaggaacttagagaagcgattaaaaaccctgcaataaaagacaaagatcatagcgcaccaaactctcgtccaattgattttgaaatgaaaaagaaagatggaactcaacagttttatcattatgcaagttctgttaaacctgctagagttattttcactgattcaaaaccagaaattgaattaggattacaatcaggtcaattttggagaaaatttgaagtttatgaaggtgacaaaaagttgccaattaaattagtatcatacgatactgttaaagattatgcttacattcgcttctctgtatcaaacggaacaaaagctgttaaaattgttagttcaacacacttcaataacaaagaagaaaaatacgattacacattaatggaattcgcacaaccaatttataacagtgcagataaattcaaaactgaagaagattataaagctgaaaaattattagcgccatataaaaaagcgaaaacactagaaagacaagtttatgaattaaataaaattcaagataaacttcctgaaaaattaaaggctgagtacaagaagaaattagaggatacaaagaaagctttagatgagcaagtgaaatcagctattactgaattccaaaatgtacaaccaacaaatgaaaaaatgactgatttacaagatacaaaatatgttgtttatgaaagtgttgagaataacgaatctatgatggatacttttgttaaacaccctattaaaacaggtatgcttaacggcaaaaaatatatggtcatggaaactactaatgacgattactggaaagatttcatggttgaaggtcaacgtgttagaactataagcaaagatgctaaaaataatactagaacaattattttcccatatgttgaaggtaaaactctatatgatgctatcgttaaagttcacgtaaaaacgattgattatgatggacaataccatgtcagaatcgttgataaagaagcatttacaaaagccaataccgataaatctaacaaaaaagaacaacaagataactcagctaagaaggaagctactccagctacgcctagcaaaccaacaccatcacctgttgaaaaagaatcacaaaaacaagacagccaaaaagatgacaataaacaattaccaagtgttgaaaaagaaaatgacgcatctagtgagtcaggtaaagacaaaacgcctgctacaaaaccaactaaaggtgaagtagaatcaagtagtacaactccaactaaggtagtatctacgactcaaaatgttgcaaaaccaacaactgcttcatcaaaaacaacaaaagatgttgttcaaacttcagcaggttctagcgaagcaaaagatagtgctccattacaaaaagcaaacattaaaaacacaaatgatggacacactcaaagccaaaacaataaaaatacacaagaaaataaagcaaaatcattaccacaaactggtgaagaatcaaataaagatatgacattaccattaatggcattattagctttaagtagcatcgttgcattcgtattacctagaaaacgtaaaaac

SEQ ID NO: 414 - protein, 645 aa, Staphylococcus aureus
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKEVKAPKETKEVKPAAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 415 - DNA, 624 bp, Staphylococcus aureus
atgaattatccaaatggtaaaccatatcgtaaaaatagtgctatagacggagggaaaaagaccgctgcctttagtaatattgagtatggtggacgtggtatgtcacttgaaaaagatatcgaacattcaaatacgttttatcttaaaagcgacattgcagttattcacaaaaagcctacgccagtacaaatagttaatgtcaactatcctaagcggagtaaagctgtgattaacgaagcttattttcgtacaccttcaacaactgattacaacggcgtttatcaaggttattatattgattttgaagcaaaggaaactaaaaacaagacgtcctttcctttaaataatattcatgaccatcaagtcgaacatatgaaaaatgcatatcaacaaaaaggtattgtgtttttaatgattcgttttaaaacgctagatgaagtttatcttttaccctattcaaaattcgaagtattttggaagagatataaagataatattaaaragtctataacagttgatgaaatacgaaaaaatggttaccatattccttatcagtatcaaccaagattagactatctaaaagcagttgataagttgatattagatgaaagtgaggaccgcgta

SEQ ID NO: 416 - protein, 208 aa, Staphylococcus aureus
  MOD_RES (168): X = anything
MNYPNGKPYRKNSAIDGGKKTAAFSNIEYGGRGMSLEKDIEHSNTFYLKSDIAVIHKKPTPVQIVNVNYPKRSKAVINEAYFRTPSTTDYNGVYQGYYIDFEAKETKNKTSFPLNNIHDHQVEHMKNAYQQKGIVFLMIRFKTLDEVYLLPYSKFEVFWKRYKDNIKXSITVDEIRKNGYHIPYQYQPRLDYLKAVDKLILDESEDRV

SEQ ID NO: 417 - DNA, 1137 bp, Staphylococcus aureus
ttgatatatctagataatgcggcaacgacgaaagcatttgaagaagtgttagatacttatttaaaagtaaatcaatcaatgtattataatccgaatagtccgcataaagctggtttgcaggcaaatcaattactacaacaagcaaaaacccaaattaatgcaatgattaattcaaaaacaaattatgatgttgtattcactagtggtgcaactgaatccaataatcttgctttaaaaggtattgcctatcgtaaatttgatacagcgaaggaaataattacatccgtgttagagcatccgtccgtattagaggttgtaagatatttggaagcacacgaaggatttaaagttaaatatgttgatgtaaagaaagatggcagtattaacttagaacacttcaaagaattaatgtcagacaaagtcggtttagtaacatgtatgtatgtaaataatgtaactggacaaatacagcctattccacaaatggctaaagttataaaaaattatcctaaggcacattttcatgtagatgcggttcaagcattcggcaaaatttcaatggatctcaataacatagatagtattagtttaagtggacacaagtttaatggtttaaaaggacaaggcgtcttacttgtaaatcacattcaaaatgttgaaccaactgtccatggtggtggtcaagaatatggcgttagaagtggaacagttaatttgccaaatgatattgcaatggttaaagcgatgaagatagctaatgaaaactttgaagcattgaatgcatttgttactgagttaaataatgacgtccgtcaatttttaaataaatatcatggagtttatattaattcttcaacttcaggttcaccattcgttttaaatattagttttcctggcgtaaaaggtgaagtattagttaatgctttttcaaaatatgacattatgatatctacgacaagtgcttgttcatctaaacgtaataaattaaatgaagtattggctgcaatgggattatcagacaaatctattgaaggtagtataagattatcatttggggctactacaactaaagaagatatagcgaggtttaaagaaatatttatcatcatttatgaggaaattaaggagttgctaaaa

SEQ ID NO: 418 - protein, 379 aa, Staphylococcus aureus
LIYLDNAATTKAFEEVLDTYLKVNQSMYYNPNSPHKAGLQANQLLQQAKTQINAMINSKTNYDVVFTSGATESNNLALKGIAYRKFDTAKEIITSVLEHPSVLEVVRYLEAHEGFKVKYVDVKKDGSINLEHFKELMSDKVGLVTCMYVNNVTGQIQPIPQMAKVIKNYPKAHFHVDAVQAFGKISMDLNNIDSISLSGHKFNGLKGQGVLLVNHIQNVEPTVHGGGQEYGVRSGTVNLPNDIAMVKAMKIANENFEALNAFVTELNNDVRQFLNKYHGVYINSSTSGSPFVLNISFPGVKGEVLVNAFSKYDIMISTTSACSSKRNKLNEVLAAMGLSDKSIEGSIRLSFGATTTKEDIARFKEIFIIIYEEIKELLK

SEQ ID NO: 419 - DNA, 1257 bp, Staphylococcus aureus
atgtcatatcattggtttaagaaaatgttactttcaacaagtattttaattttaagtagtagtagtttagggcttgcaacgcacacagttgaagcaaaggataacttaaatggagaaaaaccaactactaatttgaatcataatataacttcaccatcagtaaatagtgaaatgaataataatgagactgggacacctcacgaatcaaatcaaacgggtaatgaaggaacaggttcgaatagtcgtgatgctaatcctgattcgaataatgtgaagccagactcaaacaaccaaaacccaagtacagattcaaaaccagacccaaataaccaaaacccaagtccgaatcctaaaccagatccagataacccgaaaccaaaaccggatccaaaaccagacccagataaaccaaagccaaatccggatccaaaaccagatccagataacccgaaaccaaatccagatccaaaaccagacccagataaaccaaagccaaatccggatccaaaaccagatccagataaaccaaagccaaatccgaatccaaaaccagaccctaataagccaaatcctaacccgtcaccagatcccgatcaacctggggattccaatcattctggtggctcgaaaaatggggggacatggaacccaaatgcttcagatggatctaatcaaggtcaatggcaaccaaatgggaatcaaggaaactcacaaaatcctactggtaatgattttgtatcccaacgatttttagccttggcaaatggggcttacaagtataatccgtatattttaaatcaaattaataagttgggcaaagattatggagaagttactgatgaagacatttataatattattcgaaaacaaaatttcagcggaaatgcatatttaaatggattacaacagcaatcgaattactttagattccaatatttcaatccattgaaatcagaaaggtactatcgtaatttagatgaacaagtactcgcattaattactggtgaaattggatcaatgccagatttgaaaaagcccgaagataagccggattcaaaacaacgctcatttgaaccgcatgaaaaagacgattttacagtagttaaaaaacaagaagataataagaaaagtgcgtcaactgcatatagtaaaagttggctagcaattgtatgttctatgatggtggtattttcaatcatgctattcttatttgtaaagcgaaataaaaagaaaaataaaaacgaatcacagcgacga

SEQ ID NO: 420 - protein, 419 aa, Staphylococcus aureus
MSYHWFKKMLLSTSILILSSSSLGLATHTVEAKDNLNGEKPTTNLNHNITSPSVNSEMNNNETGTPHESNQTGNEGTGSNSRDANPDSNNVKPDSNNQNPSTDSKPDPNNQNPSPNPKPDPDNPKPKPDPKPDPDKPKPNPDPKPDPDNPKPNPDPKPDPDKPKPNPDPKPDPDKPKPNPNPKPDPNKPNPNPSPDPDQPGDSNHSGGSKNGGTWNPNASDGSNQGQWQPNGNQGNSQNPTGNDFVSQRFLALANGAYKYNPYILNQINKLGKDYGEVTDEDIYNIIRKQNFSGNAYLNGLQQQSNYFRFQYFNPLKSERYYRNLDEQVLALITGEIGSMPDLKKPEDKPDSKQRSFEPHEKDDFTVVKKQEDNKKSASTAYSKSWLAIVCSMMVVFSIMLFLFVKRNKKKNKNESQRR

SEQ ID NO: 421 - DNA, 3729 bp, Staphylococcus aureus
atgagagataagaaaggaccggtaaataaaagagtagattttctatcaaataaattgaataaatattcaataagaaaatttacagttggaacagcatctattttaattggctcactaatgtatttgggaactcaacaagaggcagaagcagctgaaaacaatattgagaatccaactacattaaaagataatgtccaatcaaaagaagtgaagattgaagaagtaacaaacaaagacactgcaccacagggtgtagaagctaaatctgaagtaacttcaaacaaagacacaatcgaacatgaaccatcagtaaaagctgaagatatatcaaaaaaggaggatacaccaaaagaagtagctgatgttgctgaagttcagccgaaatcgtcagtcactcataacgcagagacacctaaggttagaaaagctcgttctgttgatgaaggctcttttgatattacaagagattctaaaaatgtagttgaatctaccccaattacaattcaaggtaaagaacattttgaaggttacggaagtgttgatatacaaaaaaaaccaacagatttaggggtatcagaggtaaccaggtttaatgttggtaatgaaagtaatggtttgataggagctttacaattaaaaaataaaatagattttagtaaggatttcaattttaaagttagagtggcaaataaccatcaatcaaataccacaggtgctgatggttgggggttcttatttagtaaaggaaatgcagaagaatatttaactaatggtggaatccttggggataaaggtctggtaaattcaggcggatttaaaattgatactggatacatttatacaagttccatggacaaaactgaaaagcaagctggacaaggttatagaggatacggagcttttgtgaaaaatgacagttctggtaattcacaaatggttggagaaaatattgataaatcaaaaactaattttttaaactatgcggacaattcaactaatacatcagatggaaagtttcatgggcaacgtttaaatgatgtcatcttaacttatgttgcttcaactggtaaaatgagagcagaatatgctggtaaaacttgggagacttcaataacagatttaggtttatctaaaaatcaggcatataatttcttaattacatctagtcaaagatggggccttaatcaagggataaatgcaaatggctggatgagaactgacttgaaaggttcagagtttacttttacaccagaagcgccaaaaacaataacagaattagaaaaaaaagttgaagagattccattcaagaaagaacgtaaatttaatccggatttagcaccagggacagaaaaagtaacaagagaaggacaaaaaggtgagaagacaataacgacaccaacactaaaaaatccattaactggagtaattattagtaaaggtgaaccaaaagaagagattacaaaagatccgattaatgaattaacagaatacggacctgaaacaatagcgccaggtcatcgagacgaatttgatccgaagttaccaacaggagagaaagaggaagttccaggtaaaccaggaattaagaatccagaaacaggagacgtagttagaccaccggtcgatagcgtaacaaaatatggacctgtaaaaggagactcgattgtagaaaaagaagagattccattcgagaaagaacgtaaatttaatccggatttagcaccagggacagaaaaagtaacaagagaaggacaaaaaggtgagaagacaataacgacaccaacactaaaaaatccattaactggagtaattattagtaaaggtgaaccaaaagaagaaatcacaaaagatccgattaatgaattaacagaatacggaccagaaacgataacaccaggtcatcgagacgaatttgatccgaagttaccaacaggagagaaagaggaagttccaggtaaaccaggaattaagaatccagaaacaggagacgtagttagaccaccggtcgatagcgtaacaaaatatggacctgtaaaaggagactcgattgtagaaaaagaagaaattccattcaagaaagaacgtaaatttaatccggatttagcaccagggacagaaaaagtaacaagagaaggacaaaaaggtgagaagacaataacgacgccaacactaaaaaatccattaactggagaaattattagtaaaggtgaatcgaaagaagaaatcacaaaagatccgattaatgaattaacagaatacggaccagaaacgataacaccaggtcatcgagacgaatttgatccgaagttaccaacaggagagaaagaggaagttccaggtaaaccaggaattaagaatccagaaacaggagacgtagttagaccaccggtcgatagcgtaacaaaatatggacctgtaaaaggagactcgattgtagaaaaagaagaaattccattcaagaaagaacgtaaatttaatcctgatttagcaccagggacagaaaaagtaacaagagaaggacaaaaaggtgagaagacaataacgacgccaacactaaaaaatccattaactggagaaattattagtaaaggtgaatcgaaagaagaaatcacaaaagatccgattaatgaattaacagaatacggaccagaaacgataacaccaggtcatcgagacgaatttgatccgaagttaccaacaggagagaaagaggaagttccaggtaaaccaggaattaagaatccagaaacaggagatgtagttagaccaccggtcgatagcgtaacaaaatatggacctgtaaaaggagactcgattgtagaaaaagaagaaattccattcgagaaagaacgtaaatttaatcctgatttagcaccagggacagaaaaagtaacaagagaaggacaaaaaggtgagaagacaataacgacgccaacactaaaaaatccattaactggagaaattattagtaaaggtgaatcgaaagaagaaatcacaaaagatccagttaatgaattaacagaattcggtggcgagaaaataccgcaaggtcataaagatatctttgatccaaacttaccaacagatcaaacggaaaaagtaccaggtaaaccaggaatcaagaatccagacacaggaaaagtgatcgaagagccagtggatgatgtgattaaacacggaccaaaaacgggtacaccagaaacaaaaacagtagagataccgtttgaaacaaaacgtgagtttaatccaaaattacaacctggtgaagagcgagtgaaacaagaaggacaaccaggaagtaagacaatcacaacaccaatcacagtgaacccattaacaggtgaaaaagttggcgagggtcaaccaacagaagagatcacaaaacaaccagtagataagattgtagagttcggtggagagaaaccaaaagatccaaaaggacctgaaaacccagagaagccgagcagaccaactcatccaagtggcccagtaaatcctaacaatccaggattatcgaaagacagagcaaaaccaaatggcccagttcattcaatggataaaaatgataaagttaaaaaatctaaaattgctaaagaatcagtagctaatcaagagaaaaaacgagcagaattaccaaaaacaggtttagaaagcacgcaaaaaggtttgatctttagtagtataattggaattgctggattaatgttattggctcgtagaagaaagaat

SEQ ID NO: 422 - protein, 1243 aa, Staphylococcus aureus
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGVIISKGEPKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 423 - DNA, 2820 bp, Staphylococcus aureus
gtgaaaagcaatcttagatacggcataagaaaacacaaattgggagcggcctcagtattcttaggaacaatgatcgttgttggaatgggacaagaaaaagaagctgcagcatcggaacaaaacaatactacagtagaggaaagtgggagttcagctactgaaagtaaagcaagcgaaacacaaacaactacaaataacgttaatacaatagatgaaacacaatcatacagcgcgacatcaactgagcaaccatcacaatcaacacaagtaacaacagaagaagcaccgaaaactgtgcaagcaccaaaagtagaaacttcgcgagttgatttgccatcggaaaaagttgctgataaggaaactacaggaactcaagttgacatagctcaaccaagtaacgtctcagaaattaaaccaagaatgaaaagatcaactgacgttacagcagttgcagagaaagaagtagtggaagaaactaaagcgacaggtacagatgtaacaaataaagtggaagtagaagaaggtagtgaaattgtaggacataaacaagatacgaatgttgtaaatcctcataacgcagaaagagtaaccttgaaatataaatggaaatttggagaaggaattaaggcgggagattattttgatttcacattaagcgataatgttgaaactcatggtatctcaacactgcgtaaagttccggagataaaaagtacagatggtcaagttatggcgacaggagaaataattggagaaagaaaagttagatatacgtttaaagaatatgtacaagaaaagaaagatttaactgctgaattatctttaaatctatttattgatcctacaacagtgacgcaaaaaggtaaccaaaatgttgaagttaaattgggtgagactacggttagcaaaatatttaatattcaatatttaggtggagttagagataattggggagtaacagctaatggtcgaattgatactttaaataaagtagatgggaaatttagtcattttgcgtacatgaaacctaacaaccagtcgttaagctctgtgacagtaactggtcaagtaactaaaggaaataaaccaggggttaataatccaacagttaaggtatataaacacattggttcagacgatttagctgaaagcgtatatgcaaagcttgatgatgtcagcaaatttgaagatgtgactgataatatgagtttagattttgatactaatggtggttattctttaaactttaataatttagaccaaagtaaaaattatgtaataaaatatgaagggtattatgattcaaatgctagcaacttagaatttcaaacacacctttttggatattataactattattatacaagtaatttaacttggaaaaatggcgttgcattttactctaataacgctcaaggcgacggcaaagataaactaaaggaacctattatagaacatagtactcctatcgaacttgaatttaaatcagagccgccagtggagaagcatgaattgactggtacaatcgaagaaagtaatgattctaagccaattgattttgaatatcatacagctgttgaaggtgcagaaggtcatgcagaaggtaccattgaaactgaagaagattctattcatgtagactttgaagaatcgacacatgaaaattcaaaacatcatgctgatgttgttgaatatgaagaagatacaaacccaggtggtggtcaggttactactgagtctaacctagttgaatttgacgaagattctacaaaaggtattgtaactggtgctgttagcgatcatacaacaattgaagatacgaaagaatatacgactgaaagtaatctgattgaactagtagatgaactacctgaagaacatggtcaagcgcaaggaccaatcgaggaaattactgaaaacaatcatcatatttctcattctggtttaggaactgaaaatggtcacggtaattatggcgtgattgaagaaatcgaagaaaatagccacgtggatattaagagtgaattaggttacgaaggtggccaaaatagcggtaatcagtcatttgaggaagacacagaagaagataaaccgaaatatgaacaaggtggcaatatcgtagatatcgatttcgatagtgtacctcaaattcatggtcaaaataatggtaaccaatcattcgaagaagatacagagaaagacaaacctaagtatgaacaaggtggtaatatcattgatatcgacttcgacagtgtgccacatattcacggattcaataagcacactgaaattattgaagaagatacaaataaagataaaccaaattatcaattcggtggacacaatagtgttgactttgaagaagatacacttccacaagtaagtggtcataatgaaggtcaacaaacgattgaagaagatacaacacctccaatcgtgccaccaacgccaccgacaccagaagtaccaagcgagccggaaacaccaacaccaccgacaccagaagtaccaagcgagccggaaacaccaacaccgccaacgccagaggtaccaactgaacctggtaaaccaataccacctgctaaagaagaacctaaaaaaccttctaaaccagtggaacaaggtaaagtagtaacacctgttattgaaatcaatgaaaaggttaaagcagtggtaccaactaaaaaagcacaatctaagaaatctgaactacctgaaacaggtggagaagaatcaacaaacaacggcatgttgttcggcggattatttagcattttaggtttagcgttattacgcagaaataaaaagaatcacaaagca

SEQ ID NO: 424 - protein, 940 aa, Staphylococcus aureus
VKSNLRYGIRKHKLGAASVFLGTMIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKGNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQTIEEDTTPPIVPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 425 - DNA, 2316 bp, Staphylococcus aureus
atgaaagctttattacttaaaacaagtgtatggctcgttttgctttttagtgtaatgggattatggcaagtctcgaacgcggctgagcagcatacaccaatgaaagcacatgcagtaacaacgatagacaaagcaacaacagataagcaacaagtaccgccaacaaaggaagcggctcatcattctggcaaagaagcggcaaccaacgtatcagcatcagcgcagggaacagctgatgatacaaacagcaaagtaacatccaacgcaccatctaacaaaccatctacagtagtttcaacaaaagtaaacgaaacacgcgacgtagatacacaacaagcctcaacacaaaaaccaactcacacagcaacgttcaaattatcaaatgctaaaacagcatcactttcaccacgaatgtttgctgctaatgcaccacaaacaacaacacataaaatattacatacaaatgatatccatggccgactagccgaagaaaaagggcgtgtcatcggtatggctaaattaaaaacagtaaaagaacaagaaaagcctgatttaatgttagacgcaggagacgccttccaaggtttaccactttcaaaccagtctaaaggtgaagaaatggctaaagcaatgaatgcagtaggttatgatgctatggcagtcggtaaccatgaatttgactttggatacgatcagttgaaaaagttagagggtatgttagacttcccgatgctaagtactaacgtttataaagatggaaaacgcgcgtttaagccttcaacgattgtaacaaaaaatggtattcgttatggaattattggtgtaacgacaccagaaacaaagacgaaaacaagacctgaaggcattaaaggcgttgaatttagagatccattacaaagtgtgacagcggaaatgatgcgtatttataaagacgtagatacatttgttgttatatcacatttaggaattgatccttcaacacaagaaacatggcgtggtgattacttagtgaaacaattaagtcaaaatccacaattgaagaaacgtattacagttattgatggtcattcacatacagtacttcaaaatggtcaaatttataacaatgatgcattggcacaaacaggtacagcacttgcgaatatcggtaagattacatttaattatcgcaatggagaggtatcgaatattaaaccgtcattgattaatgttaaagacgttgaaaatgtaacaccgaacaaagcattagctgaacaaattaatcaagctgatcaaacatttagagcacaaactgcagaggtaattattccaaacaataccattgatttcaaaggagaaagagatgacgttagaacgcgtgaaacaaatttaggaaacgcgattgcagatgctatggaagcgtatggcgttaagaatttctctaaaaagactgactttgccgtgacaaatggtggaggtattcgtgcctctatcgcaaaaggtaaggtgacacgctatgatttaatctcagtattaccatttggaaatacgattgcgcaaattgatgtaaaaggttcagacgtctggacggctttcgaacatagtttaggcgcaccaacaacacaaaaggacggtaagacagtgttaacagcgaatggcggtttactacatatctctgattcaatccgtgtttactatgatataaataaaccgtctggcaaacgaattaatgctattcaaattttaaataaagagacaggtaagtttgaaaatattgatttaaaacgtgtatatcacgtaacgatgaatgacttcacagcatcaggtggcgacggatatagtatgttcggtggtcctagagaagaaggtatttcattagatcaagtactagcaagttatttaaaaacagctaacttagctaagtatgatacgacagaaccacaacgtatgttattaggtaaaccagcagtaagtgaacaaccagctaaaggacaacaaggtagcaaaggtagtaagtctggtaaagatacacaaccaattggtgacgacaaagtgatggatccagcgaaaaaaccagctccaggtaaagttgtattgttgctagcgcatagaggaactgttagtagcggtacagaaggttctggtcgcacaatagaaggagctactgtatcaagcaagagtgggaaacaattggctagaatgtcagtgcctaaaggtagcgcgcatgagaaacagttaccaaaaactggaactaatcaaagttcaagcccagaagcgatgtttgtattattagcaggtataggtttaatcgcgactgtacgacgtagaaaagctagc

SEQ ID NO: 426 - protein, 772 aa, Staphylococcus aureus
MKALLLKTSVWLVLLFSVMGLWQVSNAAEQHTPMKAHAVTTIDKATTDKQQVPPTKEAAHHSGKEAATNVSASAQGTADDTNSKVTSNAPSNKPSTVVSTKVNETRDVDTQQASTQKPTHTATFKLSNAKTASLSPRMFAANAPQTTTHKILHTNDIHGRLAEEKGRVIGMAKLKTVKEQEKPDLMLDAGDAFQGLPLSNQSKGEEMAKAMNAVGYDAMAVGNHEFDFGYDQLKKLEGMLDFPMLSTNVYKDGKRAFKPSTIVTKNGIRYGIIGVTTPETKTKTRPEGIKGVEFRDPLQSVTAEMMRIYKDVDTFVVISHLGIDPSTQETWRGDYLVKQLSQNPQLKKRITVIDGHSHTVLQNGQIYNNDALAQTGTALANIGKITFNYRNGEVSNIKPSLINVKDVENVTPNKALAEQINQADQTFRAQTAEVIIPNNTIDFKGERDDVRTRETNLGNAIADAMEAYGVKNFSKKTDFAVTNGGGIRASIAKGKVTRYDLISVLPFGNTIAQIDVKGSDVWTAFEHSLGAPTTQKDGKTVLTANGGLLHISDSIRVYYDINKPSGKRINAIQILNKETGKFENIDLKRVYHVTMNDFTASGGDGYSMFGGPREEGISLDQVLASYLKTANLAKYDTTEPQRMLLGKPAVSEQPAKGQQGSKGSKSGKDTQPIGDDKVMDPAKKPAPGKVVLLLAHRGTVSSGTEGSGRTIEGATVSSKSGKQLARMSVPKGSAHEKQLPKTGTNQSSSPEAMFVLLAGIGLIATVRRRKAS

SEQ ID NO: 427 - DNA, 4911 bp, Staphylococcus aureus
atgaataaaaattcgaagaagaagctcgattttcttccaaacaagcttaataagtactcaattagacgtttcactgtagggacagcttcgattttagtaggagctactttaattttcggtgttgcaaatgatcaagcagaagccgctgagaataacacaactcaaaagcaagatgatagttcagatgcaagtaaagtaaaaggtaatgttcaaactattgaacaatcttctgcaaattcaaatgaatctgatattcctgaacaagttgatgtaactaaagatacaactgaacaagcatcaacagaagaaaaagcaaatacaactgaacaagcatcaacagaagaaaaagcagatacaactgaacaagcaacaacagaagaagcgccaaaagctgaaggaacagacaaagtagaaacagaagaagcgccaaaagctgaagaaacagacaaagcaacaacagaagaagcgccaaaagctgaagaaacagacaaagcaacagaagaagcaccaaaaactgaagaaacagacaaagcaacaacagaagaagcgccagcagctgaagaaacaagcaaagcagcaacagaagaagcgccaaaagctgaagaaacaagcaaagcagcaacagaagaagcgccaaaagctgaagaaacagaaaaaacagcaacagaagaagcaccaaaaactgaagaaacagacaaagtagaaacagaagaagcgccaaaagctgaagaaacaagcaaagcagcaacagaaaaagcaccaaaagctgaagaaacaaacaaagtagaaacagaagaagcgccagcagctgaagaaacaaacaaagcagcaacagaagaaacaccagcagttgaagacacaaatgctaagagcaattcaaatgctcaaccatcagaaactgagagaactcaagttgtagatacagttgctaaagatttatataaaaaatctgaagttacagaagcagaaaaagctgaaattgaaaaagtattaccaaaagatatttcaaacttatctaatgaagaaattaaaaaaatagctttaagtgaagtacttaaagaaacagctaacaaagaaaacgcacaaccaagagcaacattccgttcagtaagcagcaatgctagaacaacaaatgttaactattcagcaacagcattaagagcagctgcacaagacacagttactaaaaaaggaactggtaactttactgcgcatggagatataatccataaaacttataaagaagaattccctaatgaaggcacgctaactgcattcaatacaaacttcaatcctaatacaggaactaaaggcgcattagaatataatgataaaatagattttaataaagactttacaattactgttccagtagcaaacaacaaccaaggtaatacaacaggagcagatggctggggcttcatgtttactcaagggaatggccaagacttcttaaaccaaggtggtattttaagagacaaaggtatggcaaatgcatctggttttaaaattgatacggcatataataatgttaatggtaaagtcgataaactcgatgcagataaaacaaacaatctaagtcaaattggcgcagcaaaagttggttacggtacatttgttaaaaatggtgcagatggtgtgactaaccaagttggtcaaaatgccctaaatacaaaagataaacctgtaaataaaataatttatgcagataatacaactaatcatcttgatggtcaattccatggccaaagattaaatgatgtagtattaaattatgatgcagcaacaagtacaataactgctacatatgcaggaaaaacatggaaagctactacagatgatttaggaattgataaatcacaaaaatataatttcttaattacttcaagtcatatgcaaaatagatattctaatggaattatgagaacaaatcttgaaggtgtaacaattacaacgcctcaagctgatttaattgatgatgtggaagtaacgaaacaaccaattcctcataaaactattcgtgagtttgatccaactctagaaccaggctcacctgatgttattgtacaaaaaggtgaagatggagagaaaacaacaactacaccaactaaagttgaccctgatacaggagatgtagttgaacgtggtgaaccaacaacagaagttacaaaaaatccagttgacgagattgtacactttacacctgaagaagtaccacaaggtcataaagatgagttcgatccaaacttaccaattgacggtacagaagaagtaccaggtaaaccaggcatcaagaatcctgaaacaggtgaagtagtaacacctccggttgacgatgtcacaaaacatggtccaaaagcaggcgaaccagaggttactaaagaagaaataccattcgagaaaaaacgtgagttcaatccagacttaaaaccaggtgaagagaaagtaacgcaagaaggacaaactggagagaaaacaacaacaacgccaacaacaattaatccattaacgggagaaaaagtaggcgaaggtgaaccaacaacagaagtaacaaaagaaccagtagatgaaatcacacaattcggtggagaagaagtaccacaaggtcataaagatgagttcgatccaaacttaccaattgacggtacagaagaagtaccaggtaaaccaggcatcaagaatcctgaaacaggtgaagtagtaacacctccggttgacgatgtcacaaaacatggtccaaaagcaggcgaaccagaggttactaaagaagaaataccattcgagaaaaaacgtgagttcaatccagacttaaaaccaggtgaagagaaagtaacgcaagaaggacaaactggagagaaaacaacaacaacgccaacaacaattaatccattaacgggagaaaaagtaggcgaaggtgaaccaacaacagaagtaacaaaagaaccagtagatgaaatcacacaattcggtggagaagaagtaccacaaggtcataaagatgagttcgatccaaacttaccaattgacggtacagaagaagtaccaggtaaaccaggcatcaagaatcctgaaacaggtgaagtagtaacacctccggttgacgatgtcacaaaacatggtccaaaagcaggcgaaccagaggttactaaagaagaaataccattcgagaaaaaacgtgagttcaatccagacttaaaaccaggtgaagagaaagtaacgcaagaaggacaaactggagagaaaacaacaacaacgccaacaacaattaatccattaacgggagaaaaagtaggcgaaggtgaaccaacaacagaagtaacaaaagaaccagtagatgaaatcacacaattcggtggagaagaagtaccacaaggtcataaagatgagttcgatccaaacttaccaattgacggtacagaagaagtaccaggtaaaccaggcatcaagaatcctgaaacaggtgaagtagtaacaccaccagtagacgatgtcacaaaacatggtccaaaagcaggcgaaccagaggttactaaagaagaaattccatatgaaactaaacgcgtattagatccaacaatggaaccaggtagtcctgataaagtagctcaaaaaggtgaaaatggtgaaaaaacaacaacaacaccaactacaattaatccattaacgggagaaaaagtaggcgaaggcgaaccaacaacggaagtaacgaaagaaccaatagacgaaattgttaactatgcacctgaaattattcctcatggtacacgtgaagaaattgatccaaacttaccagaaggtgaaactaaagttatcccaggtaaagatggcttgaaagatcctgaaactggagaaatcattgaagaaccacaagatgaagtaatcatccatggtgctaaagatgattcagatgcggacagcgattcagacgcagatagcgattctgatgcagacagcgactcagacgcagatagcgactctgatgcggacagcgattcagacagcgatagcgattcagattcagatagcgactctgatgcggacagcgattcagacagcgatagcgattcagacgcagatagcgattctgatgcagacagcgactcagacgcagatagcgactcagattcagacgcagatagcgactcagattcagacgcagatagcgactcagattcagacagcgactcagacgcagacagcgactcagattcagacagcgattcagacgcagacagcgactcagacgcagatagcgactcagattcagacagcgattcagacgcagatagcgattcagattcagatagtgactctgatgcggacagcgactcagacgcagatagcgactctgatgcggacagcgactcagacgcagatagcgattctgattcagacagcgattcagacgcagatagcgactcagacgcagatagcgattcagacgcagatagcgactcagacgcagatagcgattcagattcagatagcgactctgatgcggacagcgatagcgattcagattcagacagcgactcagacgcagatagcgactcagacgcagatagcgatagcgattctgatgcagacagcgactcagacgcagatagcgactctgatgcggacggcgactcagacgcagatagcgattctgatgcagacagcgactcagacagcgatagcgattctgattcagacagcgattcagacgcagatagcgactcagattcagacagcgattcagacgcagatagagatcataatgacaaaacagataaaccaaataataaagagttaccagatactggtaatgatgctcaaaataatggcacattatttggttcactattcgctgcgcttggaggattattcttagttggcagacgtcgtaaaaacaaaaataatgaagaaaaa

SEQ ID NO: 428 - protein, 1637 aa, Staphylococcus aureus
MNKNSKKKLDFLPNKLNKYSIRRFTVGTASILVGATLIFGVANDQAEAAENNTTQKQDDSSDASKVKGNVQTIEQSSANSNESDIPEQVDVTKDTTEQASTEEKANTTEQASTEEKADTTEQATTEEAPKAEGTDKVETEEAPKAEETDKATTEEAPKAEETDKATEEAPKTEETDKATTEEAPAAEETSKAATEEAPKAEETSKAATEEAPKAEETEKTATEEAPKTEETDKVETEEAPKAEETSKAATEKAPKAEETNKVETEEAPAAEETNKAATEETPAVEDTNAKSNSNAQPSETERTQVVDTVAKDLYKKSEVTEAEKAEIEKVLPKDISNLSNEEIKKIALSEVLKETANKENAQPRATFRSVSSNARTTNVNYSATALRAAAQDTVTKKGTGNFTAHGDIIHKTYKEEFPNEGTLTAFNTNFNPNTGTKGALEYNDKIDFNKDFTITVPVANNNQGNTTGADGWGFMFTQGNGQDFLNQGGILRDKGMANASGFKIDTAYNNVNGKVDKLDADKTNNLSQIGAAKVGYGTFVKNGADGVTNQVGQNALNTKDKPVNKIIYADNTTNHLDGQFHGQRLNDVVLNYDAATSTITATYAGKTWKATTDDLGIDKSQKYNFLITSSHMQNRYSNGIMRTNLEGVTITTPQADLIDDVEVTKQPIPHKTIREFDPTLEPGSPDVIVQKGEDGEKTTTTPTKVDPDTGDVVERGEPTTEVTKNPVDEIVHFTPEEVPQGHKDEFDPNLPIDGTEEVPGKPGIKNPETGEVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPFEKKREFNPDLKPGEEKVTQEGQTGEKTTTTPTTINPLTGEKVGEGEPTTEVTKEPVDEITQFGGEEVPQGHKDEFDPNLPIDGTEEVPGKPGIKNPETGEVVTPPVDDVTKHGPKAGEPEVTKEEIPYETKRVLDPTMEPGSPDKVAQKGENGEKTTTTPTTINPLTGEKVGEGEPTTEVTKEPIDEIVNYAPEIIPHGTREEIDPNLPEGETKVIPGKDGLKDPETGEIIEEPQDEVIIHGAKDDSDADSDSDADSDSDADSDSDADSDSDADSDSDSDSDSDSDSDSDADSDSDSDSDSDADSDSDADSDSDADSDSDSDADSDSDSDADSDSDSDSDSDADSDSDSDSDSDADSDSDADSDSDSDSDSDADSDSDSDSDSDADSDSDADSDSDADSDSDADSDSDSDSDSDADSDSDADSDSDADSDSDADSDSDSDSDSDADSDSDSDSDSDSDADSDSDADSDSDSDADSDSDADSDSDADGDSDADSDSDADSDSDSDSDSDSDSDSDADSDSDSDSDSDADRDHNDKTDKPNNKELPDTGNDAQNNGTLFGSLFAALGGLFLVGRRRKNKNNEEK

SEQ ID NO: 429 - DNA, 1524 bp, Staphylococcus aureus
ttgaaaaagaaaaacatttattcaattcgtaaactaggtgtaggtattgcatctgtaactttaggtacattacttatatctggtggcgtaacacctgctgcaaatgctgcgcaacacgatgaagctcaacaaaatgctttttatcaagtcttaaatatgcctaacttaaatgctgatcaacgcaatggttttatccaaagccttaaagatgatccaagccaaagtgctaacgttttaggtgaagctcaaaaacttaatgactctcaagctccaaaagctgatgcgcaacaaaataacttcaacaaagatcaacaaagcgccttctatgaaatcttgaacatgcctaacttaaacgaagcgcaacgtaacggcttcattcaaagtcttaaagacgacccaagccaaagcactaacgttttaggtgaagctaaaaaattaaacgaatctcaagcaccgaaagctgataacaatttcaacaaagaacaacaaaatgctttctatgaaatcttgaatatgcctaacttaaacgaagaacaacgcaatggtttcatccaaagcttaaaagatgacccaagccaaagtgctaacctattgtcagaagctaaaaagttaaatgaatctcaagcaccgaaagcggataacaaattcaacaaagaacaacaaaatgctttctatgaaatcttacatttacctaacttaaacgaagaacaacgcaatggtttcatccaaagcctaaaagatgacccaagccaaagcgctaaccttttagcagaagctaaaaagctaaatgatgctcaagcaccaaaagctgacaacaaattcaacaaagaacaacaaaatgctttctatgaaattttacatttacctaacttaactgaagaacaacgtaacggcttcatccaaagccttaaagacgatccttcagtgagcaaagaaattttagcagaagctaaaaagctaaacgatgctcaagcaccaaaagaggaagacaataacaagcctggcaaagaagacaataacaagcctggcaaagaagacaacaacaagcctggtaaagaagacaacaacaagcctggcaaagaagacggcaacaagcctggtaaagaagacaacaaaaaacctggtaaagaagatggcaacaagcctggtaaagaagacaacaaaaaacctggtaaagaagacggcaacaagcctggcaaagaagatggcaacaaacctggtaaagaagatggtaacggagtacatgtcgttaaacctggtgatacagtaaatgacattgcaaaagcaaacggcactactgctgacaaaattgctgcagataacaaattagctgataaaaacatgatcaaacctggtcaagaacttgttgttgataagaagcaaccagcaaaccatgcagatgctaacaaagctcaagcattaccagaaactggtgaagaaaatccattcatcggtacaactgtatttggtggattatcattagccttaggtgcagcgttattagctggacgtcgtcgcgaacta

SEQ ID NO: 430 - protein, 508 aa, Staphylococcus aureus
LKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 431 - DNA, 891 bp, Staphylococcus aureus
atgaagaaaacaattttactgacgatgacaactcttactttatttagtatgtcgcctaactcggctcaagcatatacgaatgatagcaaaacattagaagaagcaaagaaagcacacccaaacgcacagttcaaagtgaataaagacaccggcgcgtatacttatacatatgacaaaaacaacacgccaaacaacaatcatcaaaaccagtcacgtacaaacgacaatcatcaacacgcaaatcaacgtgatcttaacaacaatcagtaccattcttcattaagtggtcagtatacgcacattaatgacgcaattgattcacacacaccgcctcaaacgtcaccaagcaatcctttgacaccagcaataccgaatgtcgaagacaatgacgatgaattaaataacgctttttcaaaagataacaaagggcttattacaggcatcgatttagacgaattgtatgacgaattacaaatcgccgaatttaatgacaaagcaaagaccgctgacggtaaacctttagcattaggtaacggtaaaatcattgatcagcctcttatcacaagtaagaacaacttatatactgctggacaatgtacatggtatgtctttgataaacgtgccaaagatggacacacgattagtacattttggggagatgctaaaaactgggcaggccaagcttcaagcaatggcttcaaagtagatagacacccaacacgaggatcaattttacaaacagtaaatggtccatttggtcatgtagcctacgttgaaaaagttaatattgatggaagtattctaatttcagaaatgaactggattggtgaatatatcgtttcatcaagaaccatctctgcttcagaagtttcatcatataattacatccat

SEQ ID NO: 432 - protein, 297 aa, Staphylococcus aureus
MKKTILLTMTTLTLFSMSPNSAQAYTNDSKTLEEAKKAHPNAQFKVNKDTGAYTYTYDKNNTPNNNHQNQSRTNDNHQHANQRDLNNNQYHSSLSGQYTHINDAIDSHTPPQTSPSNPLTPAIPNVEDNDDELNNAFSKDNKGLITGIDLDELYDELQIAEFNDKAKTADGKPLALGNGKIIDQPLITSKNNLYTAGQCTWYVFDKRAKDGHTISTFWGDAKNWAGQASSNGFKVDRHPTRGSILQTVNGPFGHVAYVEKVNIDGSILISEMNWIGEYIVSSRTISASEVSSYNYIH

SEQ ID NO: 433 - DNA, 1311 bp, Staphylococcus aureus
atgaatcaatatcattctaatgcacaacaaccaagtgcatggcgtttttttgtctatagtttagtgggcatactatgtttctttattccttttacgattaatggtaacaacactattttcgtcgatcatgttcatctagccattcgctcaatcataggtccacttatgccctatgttgcactgattatgattttaattggtacagcgttaccaatagtgagacgtacttttatgacttcaatcacaaacttggtcattacattatttaaagttgcaggtgcaatgatcggtataatgtatgtatttaaaatcggtccatcaatactatttaaagctaactatggtccgtttttgtttgaaaaattaatgatgccattaagtatcttaattccagtaggtgcaattgcgctttctttattagtgggctatggcttattagaatttgtcggtgtttatatggagcctattatgagacctatttttaaaacaccaggaaaatccgctgtcgatgcagtggcttcgtttgtcggcagttattccttaggattattgattactaatcgtgtctataagcaagggatgtacaacaaacgagaagccacgattattgcgactggcttttcaacagtttcagcaacttttatgattatcgttgctaaaactttaggattaatgccgcattggaatttatacttttggataactttagtcatcacatttgtcgtgactgcaattactgcatggctaccgccaatcagcaatgaatcaacagaatattataacggacaagaaggagaacaagaagttgctattgaaggaagcagactgaaaactgcatatgcagaggcgatgaaacaaaatgcattaacaccatctctcgtgaagaacgtttgggacaatttgaaagacggtttagaaatgactgttggtattttaccttctatattatcgattggttttttaggactgattgtagcgaactatacaccattcattgattggcttggctatatcttctatccatttatttatattttcccaattgctgatcaggctttactagcaaaagcgtcagcgatttctattgtagagatgtttctaccatctttgttagtaactaaagctgcaatgagtactaaatttgtcgtcggtgtagtaagcgtatcagccattatctttttctcagcattagtgccatgtatactagcaactgaaattaaaatacctgtctggaaactcatcatcatttggtttttacgcgtggcgttgtcgctattaatcaccatccccgtcgctttacttatttttgga

SEQ ID NO: 434 - protein, 437 aa, Staphylococcus aureus
MNQYHSNAQQPSAWRFFVYSLVGILCFFIPFTINGNNTIFVDHVHLAIRSIIGPLMPYVALIMILIGTALPIVRRTFMTSITNLVITLFKVAGAMIGIMYVFKIGPSILFKANYGPFLFEKLMMPLSILIPVGAIALSLLVGYGLLEFVGVYMEPIMRPIFKTPGKSAVDAVASFVGSYSLGLLITNRVYKQGMYNKREATIIATGFSTVSATFMIIVAKTLGLMPHWNLYFWITLVITFVVTAITAWLPPISNESTEYYNGQEGEQEVAIEGSRLKTAYAEAMKQNALTPSLVKNVWDNLKDGLEMTVGILPSILSIGFLGLIVANYTPFIDWLGYIFYPFIYIFPIADQALLAKASAISIVEMFLPSLLVTKAAMSTKFVVGVVSVSAIIFFSALVPCILATEIKIPVWKLIIIWFLRVALSLLITIPVALLIFG

SEQ ID NO: 435 - DNA, 1056 bp, Staphylococcus aureus
atgaaaatgagaacaattgctaaaaccagtttagcactagggcttttaacaacaggcgcaattacagtaacgacgcaatcggtcaaagcagaaaaaatacaatcaactaaagttgacaaagtaccaacgcttaaagcagagcgattagcaatgataaacataacagcaggtgcaaattcagcgacaacacaagcagctaacacaagacaagaacgcacgcctaaactcgaaaaggcaccaaatactaatgaggaaaaaacctcagcttccaaaatagaaaaaatatcacaacctaaacaagaagagcagaaaacgcttaatatatcagcaacgccagcgcctaaacaagaacaatcacaaacgacaaccgaatccacaacgccgaaaactaaagtgacaacacctccatcaacaaacacgccacaaccaatgcaatctactaaatcagacacaccacaatctccaaccataaaacaagcacaaacagatatgactcctaaatatgaagatttaagagcgtattatacaaaaccgagttttgaatttgaaaagcagtttggatttatgctcaaaccatggacgacggttaggtttatgaatgttattccaaataggttcatctataaaatagctttagttggaaaagatgagaaaaaatataaagatggaccttacgataatatcgatgtatttatcgttttagaagacaataaatatcaattgaaaaaatattctgtcggtggcatcacgaagactaatagtaaaaaagttaatcacaaagtagaattaagcattactaaaaaagataatcaaggtatgatttcacgcgatgtttcagaatacatgattactaaggaagagatttccttgaaagagcttgattttaaattgagaaaacaacttattgaaaaacataatctttacggtaacatgggttcaggaacaatcgttattaaaatgaaaaacggtgggaaatatacgtttgaattacacaaaaaactgcaagagcatcgtatggcaggcactaatattgataacattgaagtgaatataaaa

SEQ ID NO: 436 - protein, 352 aa, Staphylococcus aureus
MKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTPKTKVTTPPSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMAGTNIDNIEVNIK

SEQ ID NO: 437 - DNA, 924 bp, Staphylococcus aureus
atgaaaataacaacgattgctaaaacaagtttagcactaggccttttaacaacaggtgtaatcacaacgacaacgcaagcagcaaacgcgacaacaccatcttccactaaagtggaagcaccacaatcaacaccgccctcaactaaaatagaagcaccgcaatcaaaaccaaacgcgacaacaccgccctcaactaaagtagaagcaccgcaacaaacagcaaatgcgacaacaccgccttcaactaaagtgacaacacctccatcaacaaacacgccacaaccaatgcaatctactaaatcagacacaccacaatcgccaaccacaaaacaagtaccaacagaaataaatcctaaatttaaagatttaagagcgtattatacgaaaccaagtttagaatttaaaaatgagattggtattattttaaaaaaatggacgacaataagatttatgaatgttgtcccagattatttcatatataaaattgctttagttggtaaagatgataaaaaatatggtgaaggagtacataggaatgtcgatgtatttgtcgttttagaagaaaataattacaatctggaaaaatattctgtcggtggtatcacaaagagtaatagtaaaaaagttgatcacaaagcaggagtaagaattactaaggaagataataaaggtacaatctctcatgatgtttcagaattcaagattactaaagaacagatttccttgaaagaacttgattttaaattgagaaaacaacttattgaaaaaaataatctgtacggtaacgttggttcaggtaaaattgttattaaaatgaaaaacggtggaaagtacacgtttgaattgcacaaaaaattacaagaaaatcgcatggcagatgtcattaatagtgaacaaattaaaaacatcgaagtgaatttgaaa

SEQ ID NO: 438 - protein, 308 aa, Staphylococcus aureus
MKITTIAKTSLALGLLTTGVITTTTQAANATTPSSTKVEAPQSTPPSTKIEAPQSKPNATTPPSTKVEAPQQTANATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVINSEQIKNIEVNLK

SEQ ID NO: 439 - DNA, 31497 bp, Staphylococcus aureus
gtgaattatcgtgataaaattcaaaagtttagtattcgtaaatatacagttggtacattttcaactgtcattgcgacattggtatttttaggattcaatacatcacaagcacatgctgctgaaacaaatcaaccagcaagcgtggttaaacagaaacaacaaagtaataatgaacagactgagaatcgagaatctcaagtacaaaattctcaaaattcacaaaatggtcaatcattatctgctactcatgaaaatgagcaaccaaatattagtcaagctaatttagtagatcaaaaagtagcgcaatcatctactactaatgatgaacaaccagcatctcaaaatgtaaatacaaagaaagattcggcaacggctgcgacaacacaaccagataaagaacaaagtaagcataaacaaaacgaaagtcaatctgctaataaaaatggaaacgacaatagagcggctcatgtagaaaatcatgaagcaaatgtagtaacagcttcagattcatctgataatggtaacgtacaacatgaccgaaatgaattacaagcgttttttgatgcaaattatcatgattatcgctttattgaccgtgaaaatgcagattctggcacatttaactatgtaaaaggcatttttgataagattaatacgttattaggcagtaatgatccaataaacaataaagacttgcaacttgcatacaaagaattggaacaagctgttgctttaattcgtacaatgcctcaacgtcaacagactagccgacgttcaaatagaattcaaacgcgttcggttgagtcaagagctgcagagcctagatcagtatcagactatcaaaatgcaaattcatcatattatgttgaaaatgctaatgatggttcgggctatcctgttggtacatatatcaatgcttctagtaaaggggcgccatataatttaccaactacaccatggaatacattgaaggcctctgactcaaaggaaattgctcttatgacagcgaaacaaactggagacgggtaccaatgggttattaagtttaataaaggacatgctccacatcaaaatatgatcttttggtttgcattaccagcagaccaagtgccagtaggaagaactgactttgtaacagttaattcagatggaacaaatgtacaatggagtcatggagcaggagcaggtgcaaataaaccacttcaacaaatgtgggaatatggagtaaatgatcctcatcgttcacatgactttaaaataagaaatagaagtggccaagtaatatatgactggccaactgtccatatttattctttagaagatttatctagagcgagtgattattttagtgaagctggagcgacacctgctactaaagcttttggtagacaaaattttgaatatattaatggtcaaaaacctgctgaatcaccgggtgttcctaaagtttatactttcatcggtcaaggtgatgcaagttatacaatttcatttaaaacacaaggtccaactgttaataaattgtactatgcagcaggtgggcgtgctttagagtacaatcaattatttatgtacagtcaactatacgtcgaatcaacgcaagaccatcaacaacgtcttaatggtttaagacaagtggttaatcgtacatatcgcataggtacaactaaacgtgtagaagtgagtcaaggaaatgtacaaacgaaaaaggtattagaaagtacaaacctaaatatagatgattttgttgatgatcctttaagttatgttaagacgccgagtaataaagtgttaggattttattcgaataatgcaaatactaatgcttttagaccgggtggagcccaacaattaaatgaatatcaattaagtcaattatttactgatcaaaaattacaagaagcagcaagaactagaaacccaataagattaatgattggtttcgactatcctgatgcttatggtaatagtgaaactttagttcctgttaacttaacggtattacctgaaatccaacataatattaaattctttaaaaatgacgatactcaaaatattgctgaaaaaccattttcaaaacaagctgggcatccagttttctatgtatatgcaggtaaccaagggaatgcttccgtgaatttaggtggtagcgtaacatctattcaaccattacgtattaatttaacaagtaatgagaattttacagataaagattggcaaattacaggtattccgcgtacattacacattgaaaactcgacaaatagacctaataatgccagagaacgcaatattgaacttgttggtaacttattaccaggggattactttggaacgatacgttttggacgtaaagaacaattattcgaaattcgtgttaaaccacatacaccaacaattacaacgacagctgagcaattaagaggtacagcattacaaaaagtgcctgttaatatttcgggaataccgttggatccatcggcattggtttatttagttgcaccaacaaatcaaactacgaatggtggtagtgaggcagatcaaataccatctggttatacgatacttgcgactggtacacctgatggggtgcataatacaattactatacgaccgcaagattatgttgtattcataccacctgtaggtaaacaaattagagcagtagtttattataataaagtagttgcatctaatatgagtaatgctgttactattttgccagatgacattccaccaacaatcaataatcctgttggaataaatgccaaatactatcgaggcgacgaagtcaactttacaatgggtgtctctgatagacattctggtataaaaaatacaactattacgacattgccgaatggttggacatcaaatttaacaaaagcggataagaataatggctcattatctattacaggtagagtgagtatgaatcaggcatttaacagtgatattacatttaaagtgtcagcgacagacaatgtcaataatacgacaaatgatagtcaatctaaacatgtttcaattcatgtaggtaaaattagtgaagatgctcatccgattgtattaggaaatactgagaaagttgtagtagtcaatccgactgctgtatctaatgatgaaaagcaaagcataattactgcctttatgaataaaaaccaaaatataagaggatatttagcatcaactgatccagtaactgtcgataataatggtaatgtcacattacattaccgtgatggctcatcgacaacgcttgatgctacaaatgtgatgacatacgaaccagttgtgaaacctgaataccaaactgtcaatgctgctaaaacagcaacggtaacgattgctaaaggacaatcatttagtattggtgatattaaacaatattttactttaagtaatggacaacctattccaagtggcacatttacaaatattacatctgatagaactattccaactgcacaagaagttagtcaaatgaacgcaggcacgcagttataccatataactgctacaaatgcgtatcataaagatagtgaagacttctatattagtttgaaaatcatcgatgtgaaacaaccagaaggcgatcaacgtgtatatcgtacatcaacatatgatttaactactgatgaaatctcaaaagtaaaacaagcatttattaatgcaaatagagatgtaattacgcttgccgaaggtgatatttcagttacaaatacacctaatggtgctaatgtaagtactattacagtaaatattaataaaggtcgattaacgaaatcattcgcgtcaaacctagctaatatgaatttcttgcgttgggttaatttcccacaagattatacagtgacatggacgaatgcaaaaattgcaaacagaccaacagatggtggtttatcatggtctgatgaccataaatctttaatttatcgttatgatgctacattaggtactcaaattacgacgaatgatattttaacaatgttaaaagcaacaactacagtgcctggattgcgaaataacattactggtaatgaaaaatcacaagcagaagctggcggaagacctaactttagaacgactggttattcacaatcaaatgcgacaactgatggtcaacgtcaatttacgttgaatggtcaagtgattcaagtgttagacatcatcaacccttcaaacggttatggtgggcaacctgttacaaattcaaatactcgtgcaaaccatagtaactcaactgttgttaacgtaaacgaaccggcagctaatggtgctggcgcatttacaattgaccacgttgtaaaaagtaattctacacataatgcaagtgatgcagtttataaagcacagttatacttaacgccatatggtccaaaacaatatgttgaacatttaaatcaaaatacaggaaatactactgacgctattaacatttattttgtaccaagtgacttagtgaatccaacaatttcagtaggtaattacactaatcatcaagtgttctcaggtgaaacatttacaaatactattacagcgaatgataactttggtgtgcaatctgtaactgtaccaaatacatcacaaattacaggtactgttgataataaccatcaacatgtttctgcaacggcaccaaatgtgacatcagcaactaataagacaatcaatttattagcaactgatacaagcggcaatacagctacaacttcgttcaatgtaacagtgaaacctttgcgtgataaatatcgagttggtacttcatcaacggctgctaatcctgtgagaattgccaatatttcgaataatgcgacagtatcacaagctgatcaaacgacaattattaattcgttaacgtttactgaaacagtaccaaatagaagttatgcaagagcaagtgcgaatgaaatcactagtaaaacagttagtaatgtcagtcgtactggaaataatgccaatgtcacagtaactgttacttatcaagatggaacaacatcaacagtgactgtacctgtaaagcatgtcattccagaaatcgttgcacattcgcattacactgtacaaggccaagacttcccagcaggtaatggttctagtgcatcagattactttaagttatctaatggtagtgacattgcagatgcaactattacatgggtaagtggacaagcgccaaataaagataatacacgtattggtgaagatataactgtaactgcacatatcttaattgatggcgaaacaacgccgattacgaaaacagcaacatataaagtagtaagaactgtaccgaaacatgtctttgaaacagccagaggtgttttatacccaggtgtttcagatatgtatgatgcgaaacaatatgttaagccagtaaataattcttggtcgacaaatgcgcaacatatgaatttccaatttgttggaacatatggtcctaacaaagatgttgtaggcatatctactcgtcttattagagtgacatatgataatagacaaacagaagatttaactattttatctaaagttaaacctgacccacctagaattgacgcaaactctgtgacatataaagcaggtcttacaaaccaagaaattaaagttaataacgtattaaataactcgtcagtaaaattatttaaagcagataatacaccattaaatgtcacaaatattactcatggtagcggttttagttcggttgtgacagtaagtgacgcgttaccaaatggcggaattaaagcaaaatcttcaatttcaatgaacaatgtgacgtatacgacgcaagacgaacatggtcaagttgttacagtaacaagaaatgaatctgttgattcaaatgacagtgcaacagtaacagtgacaccacaattacaagcaactactgaaggcgctgtatttattaaaggtggcgacggttttgatttcggacacgtagaaagatttattcaaaacccgccacatggggcaacggttgcatggcatgatagtccagatacatggaagaatacagtcggtaacactcataaaactgcggttgtaacattacctaatggtcaaggtacgcgtaatgttgaagttccagtcaaagtttatccagttgctaatgcaaaggcgccatcacgtgatgtgaaaggtcaaaatttgactaatggaacggatgcgatgaactacattacatttgatccaaatacaaacacaaatggtatcactgcagcatgggcaaatagacaacaaccaaataaccaacaagcaggcgtgcaacatttaaatgtcgatgtcacatatccaggtatttcagctgctaaacgagttcctgttactgttaatgtatatcaatttgaattccctcaaactacttatacgacaacggttggaggcactttagcaagtggtacgcaagcatcaggatatgcacatatgcaaaatgctactggtttaccaacagatggatttacgtataaatggaatcgtgatactacaggtacaaatgacgcaaactggtcagctatgaataaaccgaatgtggctaaagtcgttaacgcaaaatatgacgtcatctataacggacatacttttgcaacatctttaccagcgaaatttgtagtaaaagatgtgcaaccagcgaaaccaactgtgactgaaacagcggcaggagcgattacaattgcacctggagcaaaccaaacagtgaatacacatgccggtaacgtaacgacatacgctgataaattagttattaaacgtaatggtaacgttgtgacgacatttacacgtcgcaataatacgagtccatgggtgaaagaagcatctgcagcaactgtagcaggtattgctggaactaataatggtattactgttgcagcaggtactttcaaccctgctgatacaattcaagttgttgcaacgcaaggaagcggagagacagtgagtgatgagcaacgtagtgatgatttcacagttgtcgcaccacaaccgaaccaagcgactactaagatttggcaaaatggtcatattgatatcacgcctaataatccatcaggacatttaattaatccaactcaagcaatggatattgcttacactgaaaaagtgggtaatggtgcagaacatagtaagacaattaatgttgttcgtggtcaaaataatcaatggacaattgcgaataagcctgactatgtaacgttagatgcacaaactggtaaagtgacgttcaatgccaatactataaaaccaaattcatcaatcacaattactccgaaagcaggtacaggtcactcagtaagtagtaatccaagtacattaactgcaccggcagctcatactgtcaacacaactgaaattgtgaaagattatggttcaaatgtaacagcagctgaaattaacaatgcagttcaagttgctaataaacgtactgcaacgattaaaaatggcacagcaatgcctactaatttagctggtggtagcacaacgacgattcctgtgacagtaacttacaatgatggtagtactgaagaagtacaagagtccattttcacaaaagcggataaacgtgagttaatcacagctaaaaatcatttagatgatccagtaagcactgaaggtaaaaagccaggtacaattacgcagtacaataatgcaatgcataatgcgcaacaacaaatcaatactgcgaaaacagaagcacaacaagtgattaataatgagcgtgcaacaccacaacaagtttctgacgcactaactaaagttcgtgcagcacaaactaagattgatcaagctaaagcattacttcaaaataaagaagataatagccaattagtaacgtctaaaaataacttacaaagttctgtgaaccaagtaccatcaactgctggtatgacgcaacaaagtattgataactataatgcgaagaagcgtgaagcagaaactgaaataactgcagctcaacgtgttattgacaatggcgatgcaactgcacaacaaatttcagatgaaaaacatcgtgtcgataacgcattaacagcattaaaccaagcgaaacatgatttaactgcagatacacatgccttagagcaagcagtgcaacaattgaatcgcacaggtacaacgactggtaagaagccggcaagtattactgcttacaataattcgattcgtgcacttcaaagtgacttaacaagtgctaaaaatagcgctaatgctattattcaaaagccaataagaacagtacaagaagtgcaatctgcgttaacaaatgtaaatcgtgtcaatgagcgattaacgcaagcaattaatcaattagtacctttagctgataatagtgctttaaaaactgctaagacgaaacttgatgaagaaatcaataaatcagtaactactgatggtatgacacaatcatcaatccaagcatatgaaaatgctaaacgtgcgggtcaaacagaatcaacaaatgcacaaaatgttattaacaatggtgatgcgactgaccaacaaattgccgcagaaaaaacaaaagtagaagaaaaatataatagcttaaaacaagcaattgctggattaactccagacttggcaccattacaaactgcaaaaactcagttgcaaaatgatattgatcagccaacgagtacgactggtatgacaagcgcatctattgcagcatttaatgaaaaactttcagcagctagaactaaaattcaagaaattgatcgtgtattagcctcacatccagatgttgcgacaatacgtcaaaacgtgacagcagcgaatgccgctaaatcagcacttgatcaagcacgtaatggcttaacagtcgataaagcgcctttagaaaatgcgaaaaatcaactacaatatagtattgacacgcaaacaagtacaactggtatgacacaagactctataaatgcatacaatgcgaagttaacagctgcacgtaataagattcaacaaatcaatcaagtattagcaggttcaccgactgtagaacaaattaatacaaatacgtctacagcaaatcaagctaaatctgatttagatcatgcacgtcaagctttaacaccagataaagcgccgcttcaaactgcgaaaacgcaattagaacaaagcattaatcaaccaacggatacaacaggtatgacgaccgcttcgttaaatgcgtacaaccaaaaattacaagcagcgcgtcaaaagttaactgaaattaatcaagtgttgaatggcaacccaactgtccaaaatatcaatgataaagtgacagaggcaaaccaagctaaggatcaattaaatacagcacgtcaaggtttaacattagatagacagccagcgttaacaacattacatggtgcatctaacttaaaccaagcacaacaaaataatttcacgcaacaaattaatgctgctcaaaatcatgctgcgcttgaaacaattaagtctaacattacggctttaaatactgcgatgacgaaattaaaagacagtgttgcggataataatacaattaaatcagatcaaaattacactgacgcaacaccagctaataaacaagcgtatgataatgcagttaatgcggctaaaggtgtcattggagaaacgactaatccaacgatggatgttaacacagtgaaccaaaaagcagcatctgttaaatcgacgaaagatgctttagatggtcaacaaaacttacaacgtgcgaaaacagaagcaacaaatgcgattacgcatgcaagtgatttaaaccaagcacaaaagaatgcattaacacaacaagtgaatagtgcacaaaacgtgcaagcagtaaatgatattaaacaaacgactcaaagcttaaatactgctatgacaggtttaaaacgtggcgttgctaatcataaccaagtcgtacaaagtgataattatgtcaacgcagatactaataagaaaaatgattacaacaatgcatacaaccatgcgaatgacattattaatggtaatgcacaacatccagttataacaccaagtgatgttaacaatgctttatcaaatgtcacaagtaaagaacatgcattgaatggtgaagctaagttaaatgctgcgaaacaagaagcgaatactgcattaggtcatttaaacaatttaaataatgcacaacgtcaaaacttacaatcgcaaattaatggtgcgcatcaaattgatgcagttaatacaattaagcaaaatgcaacaaacttgaatagtgcaatgggtaacttaagacaagctgttgcagataaagatcaagtgaaacgtacagaagattatgcggatgcagatacagctaaacaaaatgcatataacagtgcagtttcaagtgccgaaacaatcattaatcaaacaacaaatccaacgatgtctgttgatgatgttaatcgtgcaacttcagctgttacttctaataaaaatgcattaaatggttatgaaaaattagcacaatctaaaacagatgctgcaagagcaattgatgcattaccacatttaaataatgcacaaaaagcagatgttaaatctaaaattaatgctgcatcaaatattgctggcgtaaatactgttaaacaacaaggtacagatttaaatacagcgatgggtaacttgcaaggtgcaatcaatgatgaacaaacgacgcttaatagtcaaaactatcaagatgcgacacctagtaagaaaacagcatacacaaatgcggtacaagctgcgaaagatattttaaataaatcaaatggtcaaaataaaacgaaagatcaagttactgaagcgatgaatcaagtgaattctgctaaaaataacttagatggtacgcgtttattagatcaagcgaagcaaacagcaaaacagcagttaaataatatgacgcatttaacaactgcacaaaaaacgaatttaacaaaccaaattaatagtggtactactgtcgctggtgttcaaacggttcaatcaaatgccaatacattagatcaagccatgaatacgttaagacaaagtattgccaacaaagatgcgactaaagcaagtgaagattacgtagatgctaataatgataagcaaacagcatataacaacgcagtagctgctgctgaaacgattattaatgctaatagtaatccagaaatgaatccaagtacgattacacaaaaagcagagcaagtgaatagttctaaaacggcacttaacggtgatgaaaacttagctgctgcaaaacaaaatgcgaaaacgtacttaaacacattgacaagtattacagatgctcaaaagaacaatttgattagtcaaattactagtgcgacaagagtgagtggtgttgatactgtaaaacaaaatgcgcaacatctagaccaagctatggctagcttacagaatggtattaacaacgaatctcaagtgaaatcatctgagaaatatcgtgatgctgatacaaataaacaacaagagtatgataatgctattactgcagcgaaagcgattttaaataaatcgacaggtccaaacactgcgcaaaatgcagttgaagcagcattacaacgtgttaataatgcgaaagatgcattgaatggtgatgcaaaattaattgcagctcaaaacgcagcgaaacaacatttaggtactttaacgcatatcactacagctcaacgtaatgatttaacaaatcaaatttcacaagctacaaacttagctggtgttgaatctgttaaacaaaatgcgaatagtttagatggtgctatgggtaacttacaaacggctatcaacgataagtcaggaacattagcgagccaaaacttcttggatgctgatgagcaaaaacgtaatgcatacaatcaagctgtatcagcagccgaaaccattttaaataaacaaactggaccgaatacagcgaaaacagcagtcgaacaagcacttaataatgttaataatgcgaaacatgcattaaatggtacgcaaaacttaaacaatgcgaaacaagcagcgattacagcaatcaatggcgcatctgatttaaatcaaaaacaaaaagatgcattaaaagcacaagctaatggtgctcaacgcgtatctaatgcacaagatgtacagcacaatgcgactgaactgaacacggcaatgggcacattaaaacatgccatcgcagataagacgaatacgttagcaagcagtaaatatgttaatgccgatagcactaaacaaaatgcttacacaactaaagttaccaatgctgaacatattattagcggtacgccaacggttgttacgacaccttcagaagtaacagctgcagctaatcaagtaaacagcgcgaaacaagaattaaatggtgacgaaagattacgtgaagcaaaacaaaacgccaatactgctattgatgcattaacacaattaaatacacctcaaaaagctaaattaaaagaacaagtgggacaagccaatagattagaagacgtacaaactgttcaaacaaatggacaagcattgaacaatgcaatgaaaggcttaagagatagtattgctaacgaaacaacagtcaaaacaagtcaaaactatacagacgcaagtccgaataaccaatcaacatataatagcgctgtgtcaaatgcgaaaggtatcattaatcaaactaacaatccgactatggatactagtgcgattacccaagctacaacacaagtgaataatgctaaaaatggtttaaacggtgctgaaaacttaagaaatgcacaaaacactgctaagcaaaacttaaatacattatcacacttaacaaataaccaaaaatctgccatctcatcacaaattgatcgtgcaggtcatgtgagtgaggtaactgctactaaaaatgcagcaactgagttgaatacgcaaatgggtaacttggaacaagctatccatgatcaaaacacagttaaacaaagtgttaaatttactgatgcagataaagctaaacgtgatgcgtatacaaatgcggtaagcagagctgaagcaattctgaataaaacgcaaggtgcaaatacgtctaaacaagatgttgaagcggctattcaaaatgtttcaagtgctaaaaatgcattgaatggtgatcaaaacgttacaaatgcgaagaatgcagctaaaaatgcattaaataacttaacgtcaattaataatgcacaaaaacgtgacttaacaactaaaattgatcaagcaacaactgtagctggtgttgaagctgtatctaatacgagtacacaattgaatacagcgatggctaacttgcaaaatggtattaatgataaaacaaatacactagcaagtgaaaactatcatgatgctgattcagataagaaaactgcttatactcaagccgttacgaacgcagaaaatattttaaataaaaatagtggatcaaatttagacaaaactgccgttgaaaacgcgttgtcacaagttgctaatgcgaaaggtgccctaaatggtaaccataatttagagcaagctaaatcaaatgcaaacactactataaacggacttcaacatttaacaactgctcaaaaagataaattgaaacaacaagtgcaacaagcacaaaatgttgcaggtgtagatactgttaaatcaagtgccaacacattaaatggtgctatgggtacgttaagaaatagcatacaagataacacagctacgaaaaatggccaaaactatcttgatgctacagaacgtaacaaaacaaactataacaatgctgttgatagtgctaatggtgtcattaatgcaacaagcaatccaaatatggatgctaatgcaattaaccaaatcgctacacaagtgacatcaacgaaaaatgcattagatggtacacataatttaacgcaagcgaaacaaacagcaacaaatgccatcgatggtgctactaacttaaataaagcgcaaaaagatgcgttaaaagcacaagttacaagtgcgcaacgtgttgcaaatgtaacaagtatccaacaaactgcaaatgaacttaatacagctatgggtcaattacaacatggtattgatgatgaaaatgcaacaaaacaaactcaaaaatatcgtgacgctgaacaaagtaagaaaactgcttatgatcaagctgtagctgctgcgaaagcaattttaaataaacaaacaggttcaaattcagataaagcagcagttgaccgtgcattacaacaagtaacaagtacgaaagatgcattgaatggtgatgcaaaactggcagaagcgaaagcggcagctaaacaaaacttaggcactttaaaccatattacgaatgcacaacgtactgacttagaaggccaaaacaatcaagcgacgactgttgatggcgttaatactgtaaaaacaaatgccaatacattagacggcgcaatgaatagcttacaaggttcaatcaatgataaagatgcgacattaagaaatcaaaattatcttgatgcggatgaatcaaaacgaaatgcatatacgcaagctgtcacagcggctgaaggcattttaaataaacaaactggtggtaacacatctaaagcagacgttgataatgcattaaatgcagttacaagagcgaaagcggctttaaatggtgctgacaacttaagaaatgcgaaaacttcagcaacaaatacgattgatggtttacctaacttaacacaattacaaaaagacaacttgaagcatcaagttgaacaagcgcaaaatgtagcaggtgtaaatggtgttaaagataaaggtaatacgttaaatactgccatgggtgcattacgtacaagtatccaaaatgataatacgacgaaaacaagtcaaaattatcttgatgcatctgacagcaacaaaaataattacaatactgctgtaaataatgcaaatggtgttattaatgcaacgaacaatccaaatatggatgctaatgcgattaatggcatggcaaatcaagtcaatacaacaaaagcagcgttaaatggtgcacaaaacttagctcaagctaaaacaaatgcgacgaacacaattaacaacgcacatgacttaaaccaaaaacaaaaagatgcattaaaaacacaagttaacaatgcacaacgtgtatctgatgcaaataacgttcaacacactgcaactgaattgaacagtgcgatgacagcacttaaagcagctattgctgataaagaaagaacaaaagcaagcggtaattatgtcaatgctgatcaagaaaaacgtcaagcgtatgattcaaaagtgactaacgctgaaaatatcattagtggtacaccgaatgcgacattaacagtcaatgacgtaaatagtgcggcatcacaagtcaatgcggctaaaacagcattaaatggtgataacaacttacgtgtagcgaaagagcatgccaacaatacaattgacggcttagcacaattgaataatgcacaaaaagcaaaattaaaagaacaagttcaaagtgcaactacattagatggtgttcaaactgttaaaaatagttctcaaacgttgaatacagcgatgaaaggcttaagagatagtattgcgaatgaagcaacaattaaagcaggtcaaaactacactgacgcaagtccaaataatcgtaacgagtacgacagtgcagttactgcagcaaaagcaatcattaatcaaacatcgaacccaacgatggaaccaaatactattacgcaagtaacatcacaagtgacaactaaagaacaggcattaaatggtgcgcgaaacttagctcaagctaagacaactgcgaaaaacaacttgaataacttaacatcaattaacaatgcacaaaaagatgcgttaacgcgtagcattgatggtgcaacaacagtagctggtgtaaatcaagaaactgcaaaagcaacagaattaaataacgcaatgcatagtttacaaaatggtatcaatgatgagacacaaacaaaacaaactcagaaatacctagatgcagagccaagtaagaaatcagcttatgatcaagcagtaaatgcagcgaaagcaattttaacaaaagctagtggtcaaaatgtagacaaagcagcagttgaacaagcattgcaaaatgtgaacagtacgaagacggcgttgaacggtgatgcgaaattaaatgaagctaaagcagctgcgaaacaaacgttaggtacattaacacacattaataatgcacaacgtacagcgttagacaatgaaattacacaagcaacaaatgttgaaggtgttaatacagttaaagccaaagcgcaacaattagatggtgctatgggtcaattagaaacatcaattcgtgataaagacacgacgttacaaagtcaaaattatcaagatgctgatgatgctaaacgaactgcttattctcaagcagtaaatgcagcagcaactattttaaataaaacagctggcggtaatacacctaaagcagatgttgaaagagcaatgcaagctgttacacaagcaaatactgcattaaacggtattcaaaacttagatcgtgcgaaacaggctgctaacacagcgattacaaatgcttcggacttaaatacaaaacaaaaagaagcattaaaagcacaagtaacaagtgcaggacgtgtatctgcagcaaatggtgttgaacatactgcgactgaattaaatactgcgatgacagctttaaagcgtgccattgctgataaagctgagacaaaagctagtggtaactatgtcaatgctgatgcgaataaacgtcaagcatatgatgaaaaagttacagctgccgaaaatatcgttagtggtacaccaacaccaacgttaacaccagcagatgttacaaatgcagcaacgcaagtaacgaatgctaagacgcagttaaacggtaatcataatttagaagtagcgaaacaaaatgctaacactgcaattgatggtttaacttctttaaatggtccgcaaaaagcaaaacttaaagaacaagtgggtcaagcgacgacgttgccaaatgttcaaactgttcgtgataatgcacaaacattaaacactgcaatgaaaggtctacgagatagcattgcgaatgaagcaacgattaaagcaggtcaaaactacacagatgcaagtcaaaacaaacaaactgactacaacagtgcagtcactgcagcaaaagcaatcattggtcaaacaactagtccatcaatgaatgcgcaagaaattaatcaagcgaaagaccaagtgacagctaaacaacaagcgttaaacggtcaagaaaacttaagaactgcgcaaacaaatgcgaagcaacatttgaacggcttaagtgacttaactgacgctcaaaaagatgcagtgaaacgtcaaatcgaaggtgcaacgcatgttaatgaagtaacacaagcacaaaataatgcggatgcattaaatacagctatgacgaacttgaaaaatggtattcaagatcagaatacgattaagcaaggtgttaacttcactgatgccgacgaagcgaaacgtaatgcatatacaaatgcagtgacgcaagctgaacaaattttaaataaagcacaaggtccaaatacttcaaaagacggtgtcgaaactgcgttagaaaatgtacaacgtgctaaaaacgaattgaacggtaatcaaaatgttgcgaacgctaagacaactgcgaaaaatgcattgaataacctaacatcaattaataatgcacaaaaagaagcattgaaatcacaaattgaaggtgcgacaacagttgcaggtgtaaatcaagtgtctacaacggcatctgaattaaatacagcaatgagcaacttacaaaatggtattaatgatgaagcagctacaaaagcagctcagaaatatactgatgcagatagagaaaaacaaactgcatacaatgacgctgtaacagcagctaaaacgttattagataaaacagctggttcaaatgacaataaagcagctgttgaacaagcattacaacgtgtgaatactgctaaaacagcattaaatggtgacgagcgattaaatgaagcgaagaacacagctaaacaacaagtagcgacaatgtcacacttaactgatgctcaaaaagcaaacttaacatcgcaaatcgaaagtggtacgactgttgcaggtgttcaaggtattcaagctaatgccggtactttagatcaagcaatgaatcaattaagacaaagtattgcttctaaagatgcgactaaatcaagcgaagattatcaagacgcgaatgcagatttacaaaatgcatacaatgatgcggtaactaatgctgaaggtattattagtgcaacgaataaccctgaaatgaatcctgatacaattaaccaaaaagcgagccaagtgaacagtgcgaagtctgcattgaacggtgatgaaaaattagcagcagcaaaacaaactgcgaaatcagatatcggtcgtttgacagacttgaacaatgcacaacgaactgcggcaaatgctgaagtggatcaagcaccaaatcttgcagctgtcacagcggctaaaaataaagcaacatcgttaaatacagcgatgggtaatttgaaacatgcacttgctgaaaaggataatacgaaacgtagtgtcaattacacagatgcggatcaaccaaaacaacaagcgtatgatactgcggttacacaagcagaagcaattactaatgctaatggcagcaacgcgaatgaaacacaagttcaagcagcactaaaccaattgaatcaagctaaaaatgacttgaatggtgataataaagttgctcaagcaaaagagtcagcgaaacgtgcattagcttcatatagtaacttgaataatgcgcaatcaactgcagcaactagtcaaattgacaatgcaacgacagtagcaggcgtaactgctgcacaaaatactgctaatgaattaaatacagcaatgggtcaacttcaaaatggtataaatgaccaaaacactgttaaacaacaagtgaactttacagatgctgaccaaggtaagaaagatgcttacacaaatgctgttacgaatgctcaaggtattttagataaagcacacggtcaaaatatgacgaaagcacaagttgaagctgcattaaatcaagtaacgactgctaagaatgctttaaacggtgacgcaaatgtaagacaagcaaaatcagatgcgaaagcaaacttaggtacattaacacacttaaataatgcacaaaaacaagatttaacatcacaaatcgaaggcgcaacaacagtcaacggtgtaaatggtgttaaaacgaaagcacaagacttagatggtgcaatgcaacgattacaatcagctatagcaaataaagatcaaactaaagcgagcgaaaattacatcgacgcagatccaactaagaaaacagcatttgataatgctatcacacaagctgaatcttacttaaataaagatcacggtgcgaataaagataagcaagctgttgaacaagcaattcaaagtgtaacgtctactgaaaatgctttgaacggtgacgcgaacttacaacgcgctaaaactgaagctatacaagctatcgataacttgacacatttgaatacaccacaaaaaacagcattaaaacaacaagtgaacgctgcgcaacgtgtatcaggtgtaactgatctgaaaaatagtgctacatcacttaataatgcgatggatcaattaaaacaagcaattgctgatcatgacacaattgtagctagtggtaattacactaacgcgagtcctgataagcaaggtgcttatactgatgcatataatgctgcgaaaaacattgtaaatggttcgcctaatgtgattacaaatgcagcagatgttacagcagcaacacaacgtgttaataatgctgaaacaggtttaaacggtgatacaaacttagcaactgcgaagcaacaagctaaagatgcattacgtcaaatgacacatttatctgatgcacaaaaacaaagtattactggtcaaattgatagcgcgacacaagtaactggcgttcaaagtgtgaaagacaacgcgacaaatcttgataatgcaatgaatcaacttcgaaatagtattgcgaataaagatgatgtaaaagcgagtcaaccatatgttgatgcagatagagataaacaaaatgcatacaatacagcagttacaaatgctgaaaatatcattaatgcaacgagtcagccgacacttgatccatctgcagtaacacaagcagctaatcaagtgagcactaacaaaactgcgcttaatggtgcacaaaacttagcgaataaaaagcaagaaacgactgctaacatcaaccaattaagtcatttaaataatgctcaaaagcaagatttaaatacgcaagtgacaaatgcaccaaatattagcacagtaaatcaagtgaaaactaaagctgaacaattagatcaagcaatggaacgtttaatcaacggaatccaagacaaagatcaagtgaaacaaagtgttaactttacagatgcagatccagaaaaacaaacagcatacaacaatgcggtaactgctgctgaaaatattattaatcaagcaaatggtacaaatgcgaaccaatcacaagttgaagcagcactttcaactgtaacaactacgaaacaagcgttgaatggtgatagaaaagtaacagatgctaaaaacaatgcaaaccaaacattatctacgttagataacttaaacaatgcacaaaaaggtgctgttactggaaacatcaatcaagcgcacactgtagctgaagtaacgcaagccattcaaaccgctcaggaactgaatacagcgatgggtaacttgaaaaatagcttgaatgataaagacactacacttggcagtcaaaactttgcagatgcagatccagagaagaaaaatgcatacaatgaagcggttcataatgctgaaaatattttaaataaatctacaggtacgaacgtgcctaaagatcaagttgaagcagctatgaatcaagtgaatgctacaaaagcagcgcttaatggtactcaaaaccttgaaaaagctaaacaacacgcaaatacagcaattgacggtttaagccatttaacaaatgcacaaaaagaggcattaaaacaattggtacaacaatcgactactgttgcagaagcacaaggtaatgagcaaaaagcaaacaatgttgatgcagcaatggacaaattacgtcaaagtattgcagataatgcgacaacaaaacaaaaccaaaattatactgatgcaagtcagaataaaaaggatgcgtacaataatgctgtcacaactgcacaaggtattattgatcaaactacaagtccaactttagatccgactgttatcaatcaagctgctggacaagtaagcacaactaaaaatgcattaaatggtaatgaaaacctagaggcagcgaaacaacaagcgtcacaatcattaggttcattagataacttaaataatgcgcaaaaacaaacagttactgatcaaattaatggcgcgcatactgttgatgaagcaaatcaaattaagcaaaatgcgcaaaacttaaatacagcgatgggtaacttgaaacaagcgatagctgacaaagatgctacgaaagcgacagttaacttcactgatgcagatcaagcaaaacaacaagcatataacactgctgttacaaatgctgaaaatatcatttcaaaagctaatggcggcaatgcaacacaagctgaagttgaacaagcaatcaaacaagttaatgctgcaaaacaagcattaaatggtaatgccaacgttcaacatgcaaaagacgaagcaacagcattaattaatagctctaatgaccttaaccaagcacaaaaagacgcattaaaacaacaagttcaaaatgcaactactgtagctggtgtaaacaatgttaaacaaacagcacaagagttaaacaatgctatgacacaattaaaacaaggcattgcagataaagaacaaacaaaagctgatggtaactttgtcaatgcagatcctgataagcaaaatgcatataatcaagcagtagcgaaagctgaagcattaattagtgctacgcctgatgttgtcgttacacctagcgaaattactgcagcgttaaataaagttacgcaagctaaaaatgatttaaatggtaatacaaacttagcaacggcgaaacaaaatgttcaacatgctattgatcaattgccaaacttaaaccaagcgcaacgtgatgaatacagcaaacaaatcacgcaagcaacacttgtaccaaacgtcaatgctattcaacaagcggcgacaacgcttaatgacgcgatgacacaattgaaacaaggtattgcgaataaagcacaaattaaaggtagcgagaactatcacgatgctgatactgacaagcaaacagcatatgataatgcagtaacaaaagcagaagaattgttaaaacaaacaacaaatccaacaatggatccaaatacaattcaacaagcattaactaaagtgaatgacacaaatcaagcacttaacggtaatcaaaaattagctgatgccaaacaagatgctaagacaacacttggtacactagatcatttaaatgatgctcaaaaacaagcgctaacaactcaagttgaacaagcaccagatattgcaacagttaataatgttaagcaaaatgctcaaaatctgaataatgctatgactaacttaaacaatgcattacaagataaaactgagacattaaatagcattaactttactgatgcagatcaagctaagaaagatgcttatactaatgcggtttcacatgcagaaggtattttatctaaagcaaatggcagcaatgcaagtcaaactgaagtggaacaagcgatgcaacgtgtgaacgaagcgaaacaagcattgaatggtaatgacaatgtacaacgtgcaaaagatgcagcgaaacaagtgattacaaatgcaaatgatttaaatcaagcgcaaaaagatgcattaaaacaacaagtcgatgctgcgcaaactgttgcaaatgtaaacacgattaagcaaacagcacaagatttaaatcaagcaatgacacaattgaaacaaggtattgcagataaagaccaaactaaagcaaatggtaactttgtcaatgctgatactgataagcaaaatgcttacaacaatgcggtagcacatgctgaacaaataattagtggtacaccaaatgcaaacgtggatccacaacaagtggctcaagcgttacaacaagtgaatcaagctaagggtgatttaaacggtaaccataacttacaagttgctaaagacaatgcaaatacagccattgatcagttaccaaacttaaatcaaccacaaaaaacagcattaaaagaccaagtgtcgcatgcagaacttgttacaggtgttaatgctattaagcaaaatgctgatgcgttaaataatgcaatgggtacattgaaacaacaaattcaagcgaacagtcaagtaccacagtcagttgactttacacaagcggatcaagacaaacaacaagcatataacaatgcggctaaccaagcgcaacaaatcgcaaatggcataccaacacctgtattgacgcctgatacagtaacacaagcagtgacaactatgaatcaagcgaaagatgcattaaacggtgatgaaaaattagcacaagcgaaacaagaagctttagcaaatcttgatacgttacgcgatttaaatcaaccacaacgtgatgcattacgtaaccaaatcaatcaagcacaagcgttagctacagttgaacaaactaaacaaaatgcacaaaatgtgaatacagcaatgagtaacttgaaacaaggtattgcaaacaaagatactgtcaaagcaagtgagaactatcatgatgctgatgccgataagcaaacagcatatacaaatgcagtgtctcaagcggaaggtattatcaatcaaacgacaaatccaacgcttaacccagatgaaataacacgtgcattaactcaagtgactgatgctaaaaatggcttaaacggtgaagctaaattggcaactgaaaagcaaaatgctaaagatgccgtaagtgggatgacgcatttaaacgatgctcaaaaacaagcattaaaaggtcaaatcgatcaatcgcctgaaattgctacagtgaaccaagttaaacaaacagcaacgagcctagatcaagcaatggatcaattatcacaagctattaatgataaagctcaaacattagcggacggtaattacttaaatgcagatcctgacaaacaaaatgcgtataaacaggcagtagcaaaagctgaagcattattgaataaacaaagtggtactaatgaagtacaagcacaagttgaaagcatcactaatgaagtgaacgcagcgaaacaagcattaaatggtaatgacaatttggcaaatgcaaaacaacaagcaaaacaacaattggcgaacttaacacacttaaatgatgcacaaaaacaatcatttgaaagtcaaattacacaagcgccacttgttacagatgtcactacgattaatcaaaaagcacaaacgttagatcatgcgatggaattattaagaaatagtgttgcggataatcaaacgacattagcgtctgaagattatcatgatgcaactgcgcaaagacaaaatgactataaccaagctgtaacagctgctaataatatcattaatcaaactacatcgcctacgatgaatccagatgatgttaatggtgcaacgacacaagtgaataatacgaaagttgcattagatggtgatgaaaaccttgcagcagctaaacaacaagcaaacaacagacttgatcaattagatcatttgaataatgcgcaaaagcaacagttacaatcacaaattacgcaatcatctgatattgctgcagttaatggtcacaaacaaacagcagaatctttaaatactgcgatgggtaacttaattaatgcgattgcagatcatcaagccgttgaacaacgtggtaacttcatcaatgctgatactgataaacaaactgcttataatacagcggtaaatgaagcagcagcaatgattaacaaacaaactggtcaaaatgcgaaccaaacagaagtagaacaagctattactaaagttcaaacaacacttcaagcgttaaatggagaccataatttacaagttgctaaaacaaatgcgacgcaagcaattgatgctttaacaagcttaaatgatcctcaaaaaacagcattaaaagaccaagttacagctgcaactttagtaactgcagttcatcaaattgaacaaaatgcgaatacgcttaaccaagcaatgcatggtttaagacagagcattcaagataacgcagcaactaaagcaaatagcaaatatatcaacgaagatcaaccagagcaacaaaactatgatcaagctgttcaagccgcaaataatattatcaatgaacaaactgcaacattagataataatgcgattaatcaagcagcgacaactgtgaatacaacgaaagcagcattacatggtgatgtgaagttacaaaatgataaagatcatgctaagcaaacggttagtcaattagcacatctaaacaatgcacaaaaacatatggaagatacgttaattgatagtgaaacaactagaacagcagttaagcaagatttgactgaagcacaagcattagatcaacttatggatgcattacaacaaagtattgctgacaaagatgcaacacgtgcgagcagtgcatatgtcaatgcagaaccgaataaaaaacaatcctatgatgaagcagttcaaaatgctgagtctatcattgcaggattaaataatccaactatcaataaaggtaatgtatcaagtgcgactcaagcagtaatatcatctaaaaatgcattagatggtgttgaacgattagctcaagataagcaaactgctggaaattctctaaatcatttagatcaattaacaccagctcaacaacaagcgctagaaaatcaaattaataatgcaacaactcgtggcgaagtagcacaaaaattaactgaagcacaagcacttaaccaagcaatggaagctttacgtaatagcattcaagatcaacagcaaacggaagcgggtagcaagtttatcaatgaagataaaccacaaaaagatgcttaccaagcagcagttcaaaatgcaaaagatttaattaatcaaactaacaatccaacgcttgataaagcacaagttgaacaattgacacaagctgttaaccaagctaaagataacctacacggtgatcaaaaacttgcagacgataaacaacatgcggttactgatttaaatcaattaaatggtttgaataatccgcaacgtcaagcacttgaaagccaaataaacaacgcagcaactcgtggcgaagtagcacaaaaattagctgaagcaaaagcgcttgatcaagcaatgcaagcattacgtaatagtattcaagatcaacaacaaacagaatctggtagcaagtttatcaatgaagataaaccgcaaaaagatgcttaccaagcagcagttcaaaatgcaaaagatttaattaaccaaacaggtaatccaacactcgacaaatcacaagtagaacaattgacacaagcagtaacaactgcaaaagataatctacatggtgatcaaaaacttgctcgtgatcaacaacaagcagtaacaactgtaaatgcattgccaaacttaaatcatgcacaacaacaagcattaactgatgctataaatgcagcgcctacaagaacagaggttgcacaacatgttcaaactgctactgaacttgatcacgcgatggaaacattgaaaaataaagttgatcaagtgaatacagataaggctcaaccaaattacactgaagcgtcaactgataaaaaagaagcagtagatcaagcgttacaagctgcagaaagcattacagatccaactaatggttcaaatgcgaataaagacgctgtagaccaagtattaactaagcttcaagaaaaagaaaatgagttaaatggtaatgagagagtcgctgaagctaaaacacaagcgaaacaaactattgaccaattaacacatttaaatgctgatcaaattgcaactgctaaacaaaacattgatcaagcgacgaaacttcaaccaattgctgaattagtagatcaagcaacgcaattgaatcaatctatggatcaattacaacaagcagttaatgaacatgctaacgttgagcaaactgtagattacacacaagcagattcagataaacaaaatgcttataaacaagctattgctgatgctgaaaatgtattgaaacaaaatgcgaataagcaacaagtggatcaagcacttcaaaatattttaaatgcaaaacaagcattaaatggtgatgaacgtgtagcacttgctaaaacaaatggtaaacatgacatcgaccaattgaatgcattaaacaatgctcaacaagatggatttaaaggtcgcatcgatcaatcaaacgatttaaatcaaatccaacaaattgtagatgaggctaaggcacttaatcgtgcaatggatcaattgtcacaagaaatcactgacaatgaaggacgcacgaaaggtagcacgaactatgtcaatgcagatacacaagtcaaacaagtatatgatgaaacggttgataaagcgaaacaagcacttgataaatcgactggtcaaaacttaactgcaaaacaagttatcaaattaaatgatgcagtcactgcagctaagaaagcattaaatggtgaagaaagacttaataatcgtaaagctgaagcattacaaagattggatcaattaacacatctaaacaatgctcaaagacaattagcaatccaacaaattaataatgctgaaacgctaaataaagcatctcgagcaattaatagagcaactaaattagataatgcaatgggtgcagtacaacaatatattgacgaacagcaccttggtgttatcagcagcacaaattacatcaatgcagatgacaatttgaaagcaaattatgataatgcaattgcgaatgcagcacatgagttagataaagtgcaaggtaatgcaattgcaaaagctgaagcagagcaattgaaacaaaatattatcgatgctcaaaatgcattaaatggagaccaaaaccttgcaaatgccaaagataaagcaaatgcgtttgttaattcgttaaatggattaaatcaacagcaacaagatcttgcacataaagcaattaacaatgccgatactgtatcagatgtaacagatattgttaataatcaaattgacttaaatgatgcaatggaaacattgaaacatttagttgacaatgaaattccaaatgcagagcaaactgtcaattaccaaaacgctgacgataatgctaaaacaaacttcgatgatgccaaacgtctagcaaatacattgctaaatagtgataacacaaatgtgaatgatatcaatggcgcaatccaagcagtcaatgatgcaatccataatcttaatggtgatcaacgactacaagatgctaaagacaaggcaattcaatctattaatcaagctttagctaataagctaaaagaaatcgaagcttcaaatgcgacggatcaagacaagcttattgcgaaaaataaagcagaagaattggcaaacagcatcatcaacaacattaataaagcaacaagtaatcaggctgtatctcaagttcaaacagcaggcaaccacgcgattgaacaagtgcatgccaatgaaataccaaaagcaaaaattgatgccaataaagacgttgataagcaagttcaagcattaattgacgaaattgatcgaaatccaaatctaacagataaggaaaaacaagcacttaaagatcgtattaatcaaatacttcaacaaggtcataacggcattaacaatgcgatgactaaagaagaaattgaacaagccaaagcacaacttgcgcaagcattacaagacatcaaagatttagtgaaagctaaagaagatgcgaaacaagatgttgataaacaagttcaagctttaattgacgaaatcgatcaaaatccaaatctaacagataaggaaaaacaagcacttaaagatcgtattaatcaaatacttcaacaaggtcatarcgacattamcaatgcgatgacaaaagaagcaattgaacaagcaaaagaacgtttagcgcaagcattgcaagacatcaaagatttagtgaaagctaaagaagatgcgaaaaatgatattgataaacgtgtacaagctttaattgacgaaatcgatcaaaatccaaatctaacagataaggaaaaacaagcacttaaagatcgaattaatcaaatacttcaacaaggtcataacgacattaacaatgcgctgactaaagaagaaattgagcaggcaaaagcacaacttgcacaagcattgcaagacatcaaagatttagtgaaagctaaagaagatgcgaaaaatgcaataaaagccttagctaatgcgaagcgtgatcaaatcaattcaaatccagatttaacacctgagcaaaaagcaaaagcgctcaaagaaattgacgaagctgaaaaacgagcactacaaaacgttgagaatgctcaaactatagatcaattaaatcgaggattaaacttaggtttagatgacattagaaatacacatgtatgggaggttgatgaacaacctgctgtaaatgaaatttttgaagcaacacctgagcaaatcctagttaatggtgaactcattgtacatcgtgatgacatcattacagaacaagatattcttgcacacataaacttaattgatcagctttcagcagaagtcatcgatacaccatcaactgcaacgatttctgatagcttaacagcaaaagttgaagttacattgcttgatggatcaaaagtgattgttaatgttcctgtaaaagttgtagaaaaagaattgtcagtagtcaaacaacaggcaattgaatcaatcgaaaatgcggcacaacaaaagattaatgaaatcaataatagtgtgacattaacactggaacaaaaagaagctgcaattgcagaagttaataagcttaaacaacaagcaattgatcatgttaacaatgcacctgatgttcattcagttgaagaaattcaacaacaagaacaagcgcatattgaacaatttaatccagaacaatttacgattgaacaagcaaaatcaaatgcaattaaatcgattgaagatgcaattcaacatatgattgatgaaatcaaagctcgtactgatctaacagataaagagaagcaagaagctattgctaagttaaatcaattaaaagaacaagcaattcaagcgattcaacgtgcgcaaagcatcgatgaaataagtgagcaattggaacaatttaaagctcaaatgaaagcagctaatccaacagcaaaagaactagctaaacgcaagcaagaagctattagtagaattaaagacttttcaaatgaaaaaataaatagtattcgaaatagtgaaattggcacagctgatgaaaaacaagcagcaatgaatcaaattaacgaaattgtgcttgaaacaattagagatattaataatgcgcatacattacagcaagttgaggctgcattgaacaatggtattgctcgaatttcagcagtacaaattgtaacatctgatcgtgctaaacaatcgtcaagtactggaaatgaatctaatagccatttaacaattggttatggaactgcaaatcatccatttaacagttcgactattggacataaaaagaaacttgatgaagatgatgacattgatccacttcatatgcgtcactttagtaataatttcggtaatgttattaaaaacgctattggtgtggtgggtatctctggtttactagctagtttctggttcttcattgccaaacgtcgtcgtaaagaagatgaagaggaagaattagaaataagagataataataaagattcaataaaagagactttagacgatacaaaacatttaccacttttatttgcgaaacgtcgcagaaaagaagatgaagaagatgttactgttgaagaaaaagattcgctaaataatggcgagtcactcgataaagttaaacatacgccgttcttcttaccaaaacgtcgtcgtaaagaagatgaagaagatgtggaagttacaaatgaaaacacagatgaaaaagtgttgaaagataacgaacattcaccactcttattcgcaaaacgacgcaaagataaagaggaagatgttgaaacaacaactagtattgaatctaaagatgaggacgttcctttattattggctaaaaagaaaaatcaaaaagataaccaatccaaagacaaaaagtcagcatcaaaaaatacttctaaaaaggtagcagctaaaaagaagaaaaagaaagctaagaaaaataaaaaataa

SEQ ID NO: 440 - protein, 10498 aa, Staphylococcus aureus
  MOD_RES (9728)..(9731): X = anything
VNYRDKIQKFSIRKYTVGTFSTVIATLVFLGFNTSQAHAAETNQPASVVKQKQQSNNEQTENRESQVQNSQNSQNGQSLSATHENEQPNISQANLVDQKVAQSSTTNDEQPASQNVNTKKDSATAATTQPDKEQSKHKQNESQSANKNGNDNRAAHVENHEANVVTASDSSDNGNVQHDRNELQAFFDANYHDYRFIDRENADSGTFNYVKGIFDKINTLLGSNDPINNKDLQLAYKELEQAVALIRTMPQRQQTSRRSNRIQTRSVESRAAEPRSVSDYQNANSSYYVENANDGSGYPVGTYINASSKGAPYNLPTTPWNTLKASDSKEIALMTAKQTGDGYQWVIKFNKGHAPHQNMIFWFALPADQVPVGRTDFVTVNSDGTNVQWSHGAGAGANKPLQQMWEYGVNDPHRSHDFKIRNRSGQVIYDWPTVHIYSLEDLSRASDYFSEAGATPATKAFGRQNFEYINGQKPAESPGVPKVYTFIGQGDASYTISFKTQGPTVNKLYYAAGGRALEYNQLFMYSQLYVESTQDHQQRLNGLRQVVNRTYRIGTTKRVEVSQGNVQTKKVLESTNLNIDDFVDDPLSYVKTPSNKVLGFYSNNANTNAFRPGGAQQLNEYQLSQLFTDQKLQEAARTRNPIRLMIGFDYPDAYGNSETLVPVNLTVLPEIQHNIKFFKNDDTQNIAEKPFSKQAGHPVFYVYAGNQGNASVNLGGSVTSIQPLRINLTSNENFTDKDWQITGIPRTLHIENSTNRPNNARERNIELVGNLLPGDYFGTIRFGRKEQLFEIRVKPHTPTITTTAEQLRGTALQKVPVNISGIPLDPSALVYLVAPTNQTTNGGSEADQIPSGYTILATGTPDGVHNTITIRPQDYVVFIPPVGKQIRAVVYYNKVVASNMSNAVTILPDDIPPTINNPVGINAKYYRGDEVNFTMGVSDRHSGIKNTTITTLPNGWTSNLTKADKNNGSLSITGRVSMNQAFNSDITFKVSATDNVNNTTNDSQSKHVSIHVGKISEDAHPIVLGNTEKVVVVNPTAVSNDEKQSIITAFMNKNQNIRGYLASTDPVTVDNNGNVTLHYRDGSSTTLDATNVMTYEPVVKPEYQTVNAAKTATVTIAKGQSFSIGDIKQYFTLSNGQPIPSGTFTNITSDRTIPTAQEVSQMNAGTQLYHITATNAYHKDSEDFYISLKIIDVKQPEGDQRVYRTSTYDLTTDEISKVKQAFINANRDVITLAEGDISVTNTPNGANVSTITVNINKGRLTKSFASNLANMNFLRWVNFPQDYTVTWTNAKIANRPTDGGLSWSDDHKSLIYRYDATLGTQITTNDILTMLKATTTVPGLRNNITGNEKSQAEAGGRPNFRTTGYSQSNATTDGQRQFTLNGQVIQVLDIINPSNGYGGQPVTNSNTRANHSNSTVVNVNEPAANGAGAFTIDHVVKSNSTHNASDAVYKAQLYLTPYGPKQYVEHLNQNTGNTTDAINIYFVPSDLVNPTISVGNYTNHQVFSGETFTNTITANDNFGVQSVTVPNTSQITGTVDNNHQHVSATAPNVTSATNKTINLLATDTSGNTATTSFNVTVKPLRDKYRVGTSSTAANPVRIANISNNATVSQADQTTIINSLTFTETVPNRSYARASANEITSKTVSNVSRTGNNANVTVTVTYQDGTTSTVTVPVKHVIPEIVAHSHYTVQGQDFPAGNGSSASDYFKLSNGSDIADATITWVSGQAPNKDNTRIGEDITVTAHILIDGETTPITKTATYKVVRTVPKHVFETARGVLYPGVSDMYDAKQYVKPVNNSWSTNAQHMNFQFVGTYGPNKDVVGISTRLIRVTYDNRQTEDLTILSKVKPDPPRIDANSVTYKAGLTNQEIKVNNVLNNSSVKLFKADNTPLNVTNITHGSGFSSVVTVSDALPNGGIKAKSSISMNNVTYTTQDEHGQVVTVTRNESVDSNDSATVTVTPQLQATTEGAVFIKGGDGFDFGHVERFIQNPPHGATVAWHDSPDTWKNTVGNTHKTAVVTLPNGQGTRNVEVPVKVYPVANAKAPSRDVKGQNLTNGTDAMNYITFDPNTNTNGITAAWANRQQPNNQQAGVQHLNVDVTYPGISAAKRVPVTVNVYQFEFPQTTYTTTVGGTLASGTQASGYAHMQNATGLPTDGFTYKWNRDTTGTNDANWSAMNKPNVAKVVNAKYDVIYNGHTFATSLPAKFVVKDVQPAKPTVTETAAGAITIAPGANQTVNTHAGNVTTYADKLVIKRNGNVVTTFTRRNNTSPWVKEASAATVAGIAGTNNGITVAAGTFNPADTIQVVATQGSGETVSDEQRSDDFTVVAPQPNQATTKIWQNGHIDITPNNPSGHLINPTQAMDIAYTEKVGNGAEHSKTINVVRGQNNQWTIANKPDYVTLDAQTGKVTFNANTIKPNSSITITPKAGTGHSVSSNPSTLTAPAAHTVNTTEIVKDYGSNVTAAEINNAVQVANKRTATIKNGTAMPTNLAGGSTTTIPVTVTYNDGSTEEVQESIFTKADKRELITAKNHLDDPVSTEGKKPGTITQYNNAMHNAQQQINTAKTEAQQVINNERATPQQVSDALTKVRAAQTKIDQAKALLQNKEDNSQLVTSKNNLQSSVNQVPSTAGMTQQSIDNYNAKKREAETEITAAQRVIDNGDATAQQISDEKHRVDNALTALNQAKHDLTADTHALEQAVQQLNRTGTTTGKKPASITAYNNSIRALQSDLTSAKNSANAIIQKPIRTVQEVQSALTNVNRVNERLTQAINQLVPLADNSALKTAKTKLDEEINKSVTTDGMTQSSIQAYENAKRAGQTESTNAQNVINNGDATDQQIAAEKTKVEEKYNSLKQAIAGLTPDLAPLQTAKTQLQNDIDQPTSTTGMTSASIAAFNEKLSAARTKIQEIDRVLASHPDVATIRQNVTAANAAKSALDQARNGLTVDKAPLENAKNQLQYSIDTQTSTTGMTQDSINAYNAKLTAARNKIQQINQVLAGSPTVEQINTNTSTANQAKSDLDHARQALTPDKAPLQTAKTQLEQSINQPTDTTGMTTASLNAYNQKLQAARQKLTEINQVLNGNPTVQNINDKVTEANQAKDQLNTARQGLTLDRQPALTTLHGASNLNQAQQNNFTQQINAAQNHAALETIKSNITALNTAMTKLKDSVADNNTIKSDQNYTDATPANKQAYDNAVNAAKGVIGETTNPTMDVNTVNQKAASVKSTKDALDGQQNLQRAKTEATNAITHASDLNQAQKNALTQQVNSAQNVQAVNDIKQTTQSLNTAMTGLKRGVANHNQVVQSDNYVNADTNKKNDYNNAYNHANDIINGNAQHPVITPSDVNNALSNVTSKEHALNGEAKLNAAKQEANTALGHLNNLNNAQRQNLQSQINGAHQIDAVNTIKQNATNLNSAMGNLRQAVADKDQVKRTEDYADADTAKQNAYNSAVSSAETIINQTTNPTMSVDDVNRATSAVTSNKNALNGYEKLAQSKTDAARAIDALPHLNNAQKADVKSKINAASNIAGVNTVKQQGTDLNTAMGNLQGAINDEQTTLNSQNYQDATPSKKTAYTNAVQAAKDILNKSNGQNKTKDQVTEAMNQVNSAKNNLDGTRLLDQAKQTAKQQLNNMTHLTTAQKTNLTNQINSGTTVAGVQTVQSNANTLDQAMNTLRQSIANKDATKASEDYVDANNDKQTAYNNAVAAAETIINANSNPEMNPSTITQKAEQVNSSKTALNGDENLAAAKQNAKTYLNTLTSITDAQKNNLISQITSATRVSGVDTVKQNAQHLDQAMASLQNGINNESQVKSSEKYRDADTNKQQEYDNAITAAKAILNKSTGPNTAQNAVEAALQRVNNAKDALNGDAKLIAAQNAAKQHLGTLTHITTAQRNDLTNQISQATNLAGVESVKQNANSLDGAMGNLQTAINDKSGTLASQNFLDADEQKRNAYNQAVSAAETILNKQTGPNTAKTAVEQALNNVNNAKHALNGTQNLNNAKQAAITAINGASDLNQKQKDALKAQANGAQRVSNAQDVQHNATELNTAMGTLKHAIADKTNTLASSKYVNADSTKQNAYTTKVTNAEHIISGTPTVVTTPSEVTAAANQVNSAKQELNGDERLREAKQNANTAIDALTQLNTPQKAKLKEQVGQANRLEDVQTVQTNGQALNNAMKGLRDSIANETTVKTSQNYTDASPNNQSTYNSAVSNAKGIINQTNNPTMDTSAITQATTQVNNAKNGLNGAENLRNAQNTAKQNLNTLSHLTNNQKSAISSQIDRAGHVSEVTATKNAATELNTQMGNLEQAIHDQNTVKQSVKFTDADKAKRDAYTNAVSRAEAILNKTQGANTSKQDVEAAIQNVSSAKNALNGDQNVTNAKNAAKNALNNLTSINNAQKRDLTTKIDQATTVAGVEAVSNTSTQLNTAMANLQNGINDKTNTLASENYHDADSDKKTAYTQAVTNAENILNKNSGSNLDKTAVENALSQVANAKGALNGNHNLEQAKSNANTTINGLQHLTTAQKDKLKQQVQQAQNVAGVDTVKSSANTLNGAMGTLRNSIQDNTATKNGQNYLDATERNKTNYNNAVDSANGVINATSNPNMDANAINQIATQVTSTKNALDGTHNLTQAKQTATNAIDGATNLNKAQKDALKAQVTSAQRVANVTSIQQTANELNTAMGQLQHGIDDENATKQTQKYRDAEQSKKTAYDQAVAAAKAILNKQTGSNSDKAAVDRALQQVTSTKDALNGDAKLAEAKAAAKQNLGTLNHITNAQRTDLEGQNNQATTVDGVNTVKTNANTLDGAMNSLQGSINDKDATLRNQNYLDADESKRNAYTQAVTAAEGILNKQTGGNTSKADVDNALNAVTRAKAALNGADNLRNAKTSATNTIDGLPNLTQLQKDNLKHQVEQAQNVAGVNGVKDKGNTLNTAMGALRTSIQNDNTTKTSQNYLDASDSNKNNYNTAVNNANGVINATNNPNMDANAINGMANQVNTTKAALNGAQNLAQAKTNATNTINNAHDLNQKQKDALKTQVNNAQRVSDANNVQHTATELNSAMTALKAAIADKERTKASGNYVNADQEKRQAYDSKVTNAENIISGTPNATLTVNDVNSAASQVNAAKTALNGDNNLRVAKEHANNTIDGLAQLNNAQKAKLKEQVQSATTLDGVQTVKNSSQTLNTAMKGLRDSIANEATIKAGQNYTDASPNNRNEYDSAVTAAKAIINQTSNPTMEPNTITQVTSQVTTKEQALNGARNLAQAKTTAKNNLNNLTSINNAQKDALTRSIDGATTVAGVNQETAKATELNNAMHSLQNGINDETQTKQTQKYLDAEPSKKSAYDQAVNAAKAILTKASGQNVDKAAVEQALQNVNSTKTALNGDAKLNEAKAAAKQTLGTLTHINNAQRTALDNEITQATNVEGVNTVKAKAQQLDGAMGQLETSIRDKDTTLQSQNYQDADDAKRTAYSQAVNAAATILNKTAGGNTPKADVERAMQAVTQANTALNGIQNLDRAKQAANTAITNASDLNTKQKEALKAQVTSAGRVSAANGVEHTATELNTAMTALKRAIADKAETKASGNYVNADANKRQAYDEKVTAAENIVSGTPTPTLTPADVTNAATQVTNAKTQLNGNHNLEVAKQNANTAIDGLTSLNGPQKAKLKEQVGQATTLPNVQTVRDNAQTLNTAMKGLRDSIANEATIKAGQNYTDASQNKQTDYNSAVTAAKAIIGQTTSPSMNAQEINQAKDQVTAKQQALNGQENLRTAQTNAKQHLNGLSDLTDAQKDAVKRQIEGATHVNEVTQAQNNADALNTAMTNLKNGIQDQNTIKQGVNFTDADEAKRNAYTNAVTQAEQILNKAQGPNTSKDGVETALENVQRAKNELNGNQNVANAKTTAKNALNNLTSINNAQKEALKSQIEGATTVAGVNQVSTTASELNTAMSNLQNGINDEAATKAAQKYTDADREKQTAYNDAVTAAKTLLDKTAGSNDNKAAVEQALQRVNTAKTALNGDERLNEAKNTAKQQVATMSHLTDAQKANLTSQIESGTTVAGVQGIQANAGTLDQAMNQLRQSIASKDATKSSEDYQDANADLQNAYNDAVTNAEGIISATNNPEMNPDTINQKASQVNSAKSALNGDEKLAAAKQTAKSDIGRLTDLNNAQRTAANAEVDQAPNLAAVTAAKNKATSLNTAMGNLKHALAEKDNTKRSVNYTDADQPKQQAYDTAVTQAEAITNANGSNANETQVQAALNQLNQAKNDLNGDNKVAQAKESAKRALASYSNLNNAQSTAATSQIDNATTVAGVTAAQNTANELNTAMGQLQNGINDQNTVKQQVNFTDADQGKKDAYTNAVTNAQGILDKAHGQNMTKAQVEAALNQVTTAKNALNGDANVRQAKSDAKANLGTLTHLNNAQKQDLTSQIEGATTVNGVNGVKTKAQDLDGAMQRLQSAIANKDQTKASENYIDADPTKKTAFDNAITQAESYLNKDHGANKDKQAVEQAIQSVTSTENALNGDANLQRAKTEAIQAIDNLTHLNTPQKTALKQQVNAAQRVSGVTDLKNSATSLNNAMDQLKQAIADHDTIVASGNYTNASPDKQGAYTDAYNAAKNIVNGSPNVITNAADVTAATQRVNNAETGLNGDTNLATAKQQAKDALRQMTHLSDAQKQSITGQIDSATQVTGVQSVKDNATNLDNAMNQLRNSIANKDDVKASQPYVDADRDKQNAYNTAVTNAENIINATSQPTLDPSAVTQAANQVSTNKTALNGAQNLANKKQETTANINQLSHLNNAQKQDLNTQVTNAPNISTVNQVKTKAEQLDQAMERLINGIQDKDQVKQSVNFTDADPEKQTAYNNAVTAAENIINQANGTNANQSQVEAALSTVTTTKQALNGDRKVTDAKNNANQTLSTLDNLNNAQKGAVTGNINQAHTVAEVTQAIQTAQELNTAMGNLKNSLNDKDTTLGSQNFADADPEKKNAYNEAVHNAENILNKSTGTNVPKDQVEAAMNQVNATKAALNGTQNLEKAKQHANTAIDGLSHLTNAQKEALKQLVQQSTTVAEAQGNEQKANNVDAAMDKLRQSIADNATTKQNQNYTDASQNKKDAYNNAVTTAQGIIDQTTSPTLDPTVINQAAGQVSTTKNALNGNENLEAAKQQASQSLGSLDNLNNAQKQTVTDQINGAHTVDEANQIKQNAQNLNTAMGNLKQAIADKDATKATVNFTDADQAKQQAYNTAVTNAENIISKANGGNATQAEVEQAIKQVNAAKQALNGNANVQHAKDEATALINSSNDLNQAQKDALKQQVQNATTVAGVNNVKQTAQELNNAMTQLKQGIADKEQTKADGNFVNADPDKQNAYNQAVAKAEALISATPDVVVTPSEITAALNKVTQAKNDLNGNTNLATAKQNVQHAIDQLPNLNQAQRDEYSKQITQATLVPNVNAIQQAATTLNDAMTQLKQGIANKAQIKGSENYHDADTDKQTAYDNAVTKAEELLKQTTNPTMDPNTIQQALTKVNDTNQALNGNQKLADAKQDAKTTLGTLDHLNDAQKQALTTQVEQAPDIATVNNVKQNAQNLNNAMTNLNNALQDKTETLNSINFTDADQAKKDAYTNAVSHAEGILSKANGSNASQTEVEQAMQRVNEAKQALNGNDNVQRAKDAAKQVITNANDLNQAQKDALKQQVDAAQTVANVNTIKQTAQDLNQAMTQLKQGIADKDQTKANGNFVNADTDKQNAYNNAVAHAEQIISGTPNANVDPQQVAQALQQVNQAKGDLNGNHNLQVAKDNANTAIDQLPNLNQPQKTALKDQVSHAELVTGVNAIKQNADALNNAMGTLKQQIQANSQVPQSVDFTQADQDKQQAYNNAANQAQQIANGIPTPVLTPDTVTQAVTTMNQAKDALNGDEKLAQAKQEALANLDTLRDLNQPQRDALRNQINQAQALATVEQTKQNAQNVNTAMSNLKQGIANKDTVKASENYHDADADKQTAYTNAVSQAEGIINQTTNPTLNPDEITRALTQVTDAKNGLNGEAKLATEKQNAKDAVSGMTHLNDAQKQALKGQIDQSPEIATVNQVKQTATSLDQAMDQLSQAINDKAQTLADGNYLNADPDKQNAYKQAVAKAEALLNKQSGTNEVQAQVESITNEVNAAKQALNGNDNLANAKQQAKQQLANLTHLNDAQKQSFESQITQAPLVTDVTTINQKAQTLDHAMELLRNSVADNQTTLASEDYHDATAQRQNDYNQAVTAANNIINQTTSPTMNPDDVNGATTQVNNTKVALDGDENLAAAKQQANNRLDQLDHLNNAQKQQLQSQITQSSDIAAVNGHKQTAESLNTAMGNLINAIADHQAVEQRGNFINADTDKQTAYNTAVNEAAAMINKQTGQNANQTEVEQAITKVQTTLQALNGDHNLQVAKTNATQAIDALTSLNDPQKTALKDQVTAATLVTAVHQIEQNANTLNQAMHGLRQSIQDNAATKANSKYINEDQPEQQNYDQAVQAANNIINEQTATLDNNAINQAATTVNTTKAALHGDVKLQNDKDHAKQTVSQLAHLNNAQKHMEDTLIDSETTRTAVKQDLTEAQALDQLMDALQQSIADKDATRASSAYVNAEPNKKQSYDEAVQNAESIIAGLNNPTINKGNVSSATQAVISSKNALDGVERLAQDKQTAGNSLNHLDQLTPAQQQALENQINNATTRGEVAQKLTEAQALNQAMEALRNSIQDQQQTEAGSKFINEDKPQKDAYQAAVQNAKDLINQTNNPTLDKAQVEQLTQAVNQAKDNLHGDQKLADDKQHAVTDLNQLNGLNNPQRQALESQINNAATRGEVAQKLAEAKALDQAMQALRNSIQDQQQTESGSKFINEDKPQKDAYQAAVQNAKDLINQTGNPTLDKSQVEQLTQAVTTAKDNLHGDQKLARDQQQAVTTVNALPNLNHAQQQALTDAINAAPTRTEVAQHVQTATELDHAMETLKNKVDQVNTDKAQPNYTEASTDKKEAVDQALQAAESITDPTNGSNANKDAVDQVLTKLQEKENELNGNERVAEAKTQAKQTIDQLTHLNADQIATAKQNIDQATKLQPIAELVDQATQLNQSMDQLQQAVNEHANVEQTVDYTQADSDKQNAYKQAIADAENVLKQNANKQQVDQALQNILNAKQALNGDERVALAKTNGKHDIDQLNALNNAQQDGFKGRIDQSNDLNQIQQIVDEAKALNRAMDQLSQEITDNEGRTKGSTNYVNADTQVKQVYDETVDKAKQALDKSTGQNLTAKQVIKLNDAVTAAKKALNGEERLNNRKAEALQRLDQLTHLNNAQRQLAIQQINNAETLNKASRAINRATKLDNAMGAVQQYIDEQHLGVISSTNYINADDNLKANYDNAIANAAHELDKVQGNAIAKAEAEQLKQNIIDAQNALNGDQNLANAKDKANAFVNSLNGLNQQQQDLAHKAINNADTVSDVTDIVNNQIDLNDAMETLKHLVDNEIPNAEQTVNYQNADDNAKTNFDDAKRLANTLLNSDNTNVNDINGAIQAVNDAIHNLNGDQRLQDAKDKAIQSINQALANKLKEIEASNATDQDKLIAKNKAEELANSIINNINKATSNQAVSQVQTAGNHAIEQVHANEIPKAKIDANKDVDKQVQALIDEIDRNPNLTDKEKQALKDRINQILQQGHNGINNAMTKEEIEQAKAQLAQALQDIKDLVKAKEDAKQDVDKQVQALIDEIDQNPNLTDKEKQALKDRINQILQQGHXDIXNAMTKEAIEQAKERLAQALQDIKDLVKAKEDAKNDIDKRVQALIDEIDQNPNLTDKEKQALKDRINQILQQGHNDINNALTKEEIEQAKAQLAQALQDIKDLVKAKEDAKNAIKALANAKRDQINSNPDLTPEQKAKALKEIDEAEKRALQNVENAQTIDQLNRGLNLGLDDIRNTHVWEVDEQPAVNEIFEATPEQILVNGELIVHRDDIITEQDILAHINLIDQLSAEVIDTPSTATISDSLTAKVEVTLLDGSKVIVNVPVKVVEKELSVVKQQAIESIENAAQQKINEINNSVTLTLEQKEAAIAEVNKLKQQAIDHVNNAPDVHSVEEIQQQEQAHIEQFNPEQFTIEQAKSNAIKSIEDAIQHMIDEIKARTDLTDKEKQEAIAKLNQLKEQAIQAIQRAQSIDEISEQLEQFKAQMKAANPTAKELAKRKQEAISRIKDFSNEKINSIRNSEIGTADEKQAAMNQINEIVLETIRDINNAHTLQQVEAALNNGIARISAVQIVTSDRAKQSSSTGNESNSHLTIGYGTANHPFNSSTIGHKKKLDEDDDIDPLHMRHFSNNFGNVIKNAIGVVGISGLLASFWFFIAKRRRKEDEEEELEIRDNNKDSIKETLDDTKHLPLLFAKRRRKEDEEDVTVEEKDSLNNGESLDKVKHTPFFLPKRRRKEDEEDVEVTNENTDEKVLKDNEHSPLLFAKRRKDKEEDVETTTSIESKDEDVPLLLAKKKNQKDNQSKDKKSASKNTSKKVAAKKKKKKAKKNKK

SEQ ID NO: 441 - DNA, 2523 bp, Staphylococcus epidermidis
atgttctttgatgatgctaaagaagcatcaagagtacttgaaataacattgacgaaaagagatgctaaaaaagaaaatcctattccgatgtgtggcgtaccatatcattctgctgataattacattgaaacattgattaataaggggtataaggtcgctatatgtgaacaaatggaagatccaaagcaaacaaaaggaatggttagaagagaagttgtaagaatcatcacaccaggaactgttatggatcaaaatggtatggatgaaaagaaaaataattatattttaagttttatcgaaaatgaagaatttggattatgctattgtgatgtttctacaggagaactcaaagtaactcatttcaaagatacagcaaccttgcttaatgagattacaacaattaatcccaatgaaatcgtcataaagcaagctctatctgaagaattaaaaagacaaatcaacatgataactgagacgattactgttcgcgaagatatatctgatgaagattatgatatgaatcagttgacacatcagttaatgcatgacacaactcaattattgttagattacattcatcacacacaaaagcgagatttatctcatattgaggaagtaattgaatatgctgcagttgattatatgaagatggattattatgcgaagcgaaatttagagctgacagagagcatacgattaaaatcaaaaaaagggactttgttatggttaatggatgagacaaaaacaccgatgggtgctagacgtttaaagcagtggattgatcgtccattaattaataaacaacaaatcaacgacagattaaatattgttgaagagtttatggaccgttttattgaaagagatacattacgtaatcatttaaatcaagtgtatgacatagaacgactagtaggaagagtgagttatggaaacgtaaatgcaagagatttaatacaacttaagcattctatatccgaaatacctcacattaaagcattactcaatgaattgggtgcacaaactaccacgcaatttaaagaattagaacctttagatgacttgttacaaattttagaagaaagtttagttgaagaaccacctatttccatcaaagatggaggattatttaaaaatggcttcaacgcgcaacttgatgaatatttagaagcttcaaaaaatggtaaaacttggcttgcagaattacaagctaaggaacgtgaacgtacaggtattaagtcattgaaaattagttttaataaagtgtttggttattttattgaaattacacgtgcaaacttaaataattttcaacctgaagcgtttggctataatcgaaaacaaacattatctaatgctgaacgatttattacggatgaattaaaagaaaaagaagatataatacttggtgctgaagataaagcagtagagttagaatatgaattatttgttaaattacgagaacacattaaaacgtacactgaacgtttacaaaagcaagcgaaaatcatttcagaacttgattgtttacaaagttttgctgaaattgctcaaaaatataattatgtcaaacctacatttagtgatgataaagttttacatttagaaaactcaagacatcctgttgttgagagagtgatggattataatgattatgtacctaatgattgccatcttgatgatgaaacgtttatttatctcattacgggacctaatatgtcaggtaagtcaacatatatgagacaagttgctataataagtatcatggctcaaatgggagcatatgtaccatgtgattcagcaacattacctatatttgatcaaatttttactaggattggtgcagcagatgatcttgtatcaggtaaaagtacatttatggtagaaatgttagaagctcaaaaagctttaacttatgctactgaaaatagtttaattatctttgacgaaataggaagaggtacatccacttatgatggtcttgcgttagcgcaagcgatgattgaatatgttgctcaaacttcccatgctaagacacttttctcaacacattatcatgaattgacatcacttgatcaaatgcttaagtgtttaaaaaatgtacatgttgctgcaaacgagtatcaaggtgaactgatatttttgcataaagtcaaagatggcgctgtggatgatagctatggtattcaagtggcaaaattagcggatttacctaatgaagtcattgatagagcgcaagttatattaaatgcatttgagcaaaaaccttcgtatcaactctctcatgagaatactgacaatcaacaaacggttccgtcgtataacgattttggtcgaacagaagaagagcaatcagttatagaaacacatacatcaaatcataattatgagcaagcgacctttgatttatttgatggttacaatcaacaaagtgaagttgaatgtcaaattcgagaattgaatctatccaatatgacaccattggaagccttaatcaagctgaatgaattacaaagtcaattaaag

SEQ ID NO: 442 - protein, 841 aa, Staphylococcus epidermidis
MFFDDAKEASRVLEITLTKRDAKKENPIPMCGVPYHSADNYIETLINKGYKVAICEQMEDPKQTKGMVRREVVRIITPGTVMDQNGMDEKKNNYILSFIENEEFGLCYCDVSTGELKVTHFKDTATLLNEITTINPNEIVIKQALSEELKRQINMITETITVREDISDEDYDMNQLTHQLMHDTTQLLLDYIHHTQKRDLSHIEEVIEYAAVDYMKMDYYAKRNLELTESIRLKSKKGTLLWLMDETKTPMGARRLKQWIDRPLINKQQINDRLNIVEEFMDRFIERDTLRNHLNQVYDIERLVGRVSYGNVNARDLIQLKHSISEIPHIKALLNELGAQTTTQFKELEPLDDLLQILEESLVEEPPISIKDGGLFKNGFNAQLDEYLEASKNGKTWLAELQAKERERTGIKSLKISFNKVFGYFIEITRANLNNFQPEAFGYNRKQTLSNAERFITDELKEKEDIILGAEDKAVELEYELFVKLREHIKTYTERLQKQAKIISELDCLQSFAEIAQKYNYVKPTFSDDKVLHLENSRHPVVERVMDYNDYVPNDCHLDDETFIYLITGPNMSGKSTYMRQVAIISIMAQMGAYVPCDSATLPIFDQIFTRIGAADDLVSGKSTFMVEMLEAQKALTYATENSLIIFDEIGRGTSTYDGLALAQAMIEYVAQTSHAKTLFSTHYHELTSLDQMLKCLKNVHVAANEYQGELIFLHKVKDGAVDDSYGIQVAKLADLPNEVIDRAQVILNAFEQKPSYQLSHENTDNQQTVPSYNDFGRTEEEQSVIETHTSNHNYEQATFDLFDGYNQQSEVECQIRELNLSNMTPLEALIKLNELQSQLK

SEQ ID NO: 443 - DNA, 3654 bp, Staphylococcus epidermidis
atgattccaactaaacctcatgatgtgatttggacagatgcacaatggcaaagtatttatgcgaaaggacaggacatacttgttgctgctgcagcaggttccggtaaaacagccgttctagttgagcgtattatacaacgtatactaagagatgatgtagatgtagatcggttactagttgtaacatttacgaatttaagcgcacgtgagatgaagcatcgagttgataaacgtatacaagaagcatcttttaaggatcctaacaatgaacatttaaagaatcagcgaatcaaaattcatcaagcacagatttctactttacacagtttctgtttgaaattgattcagcagcattatgatgtattagatatcgatcctcattttagaacaagtagtgaagcggaaaatatattattattagaacaaactattgatgatgttttagaacaacactatgataaattagatcctcactttatagaattaaccgaacaactatcatcagataggaatgatgatcaatttagaagtattattaagcagttatattttttcagtattgctaatcctcaaccatttgaatggctcaatcaattagcgcaaccatacaaagaagaaaataaacagcaacaattaatgcagcttatcaatgatttagcaatgatttttatgaaagcaggatatgaggaattacaaaaaagttatgacttattctcaatgatggaaagtgttgataagcagcttgaagttattgaaaccgaacgcatgtttattactaaagctattgaaggtaaagtattaaatacagatgttatcacgcaacatgaatttatgagtcgttttccggcaataaatagcaagataaaagaagcaaatgaaggcatggaagatgctttaaatgaagcaaaacaacattatgataaatataaatctttagttatgaaagtaaagaatgattatttttctagaaatgcagaagatttgcaaagagatatgcaacaactcgcacctcgagtggcttatttagctcaaatagttcaagatgtgattcaatcatttggtgttcaaaaacgaagtcgtaatattttggatttttcagattatgaacattttgcattacgcattcttactaacgaagatggctcaccttcgcgtatcgctgaaacgtatcgtgaacattttaaagaaatcctagttgatgagtatcaagatactaatagagtgcaagaaaaaatattatcttgtattaaaactggtgaagaacacgatggtaacttgttcatggttggggatgtgaagcagtctatttataaatttagacaagctgatcctagtttatttattgaaaaatataatcgcttttctagtagtggaaatgaaagtggcttgcgcattgacttatcgcaaaactttcgttcgagacaggaagtgttatctacaaccaattacttgttcaaacatatgatggatgaacaagtaggagaaatttcatatgatgatgcagcgcaattgtattttggtgcaccatatgacgaagtttcacatcctgttcaattacgagcacttgttgaggcaagttcagaaaatagtgacttaactggaagtgaacaagaagcgaattacattgttgaacaagttaaagatattattaatcatcaaaacgtatacgatatgaaaacaggtcaatacagaaaagcaacatataaagatatcgtaattttagagcgaagttttggtcaagcgcgtaatcttcaacaagcttttaaaaataatgatatcccttttcacgtaaatagtaaggaagggtattttgagcaaactgaagtacgtcttgtgctttcatttttaagaacaatagataatccacttcaagacatttatttagtgggattgatgcgttctgtaatatatcaatttactgaagaagaattagctgaaataagagttgtaagccctcatgatgattacttttatcaatctataaaaaattatatgattgatgaaaaagctgattctagattggttgacaagttaaatcgttttattcaggatatacaaaaatatcaaaattatagtcaaagtcaaccggtttaccaattaattgataaattttataatgatcattttgtaattcagtactttagcggtcttattggaggtaaaggtagaagagcaaatctgtatgggctatttaataaagctgttgaatttgaaaattcaagtttcagaggtttattccaatttattcgttttattgatgagcttattgatcgtaaaaaagattttggtgaagaaaatgtcgtaggtcctaacgataatgtggttagaatgatgacgattcacagtagtaaaggattagaatttccatttgtaatttactcaggattatctaaaaaattcaacaaaggtgacctgaatgcaccagttattctaaatcaacaatatggtttaggtatggattattttgatgtaaataaagatatggcttttccttcacttgcctctgtggcatatagagcaataaatgaaaaagaacttatatcagaagagatgcgtttaatctatgttgcgttgacacgagcaaaagagcaacttattttagttggaagagtcaaagatgaaaagtcgttaattaaatatgaacaattagctgtttcagacacacatatagcagttaatgaacgccttactgctaccaatccatttgttctaatttatggtgttttggctaagcatcaatcgccttcattgccaaatgatcaaagatttgaaagagatattgatcaattaaattctgaagtgaagccacgtgtatcaatagtgattgatcattatgaggatgtttcaactgaagaagtagtcaatgataatgaaataagaacaatcgaagaattaaaggccataaatactggtaatgaagatgtgaaaattaaaattcatcaacagctttcttatgactatccttttaaagttaacacgatgaaaccatctaaacagtcggtatcagagttaaaacgtcaattagaaactgaagaaagtaatacaaattatgatagagtacgtcaatatcgtattggtgttgcatcatatgaaagacccaagtttcttacccaaacaaaaaaaagaaaagcaaatgaaatagggactttaatgcatacagtcatgcaacacttaccttttagagaacaacgtttaacaaaagacgaattatttcaatatatcgatcgattgattgacaaacaacttattgatgaagatgcaaaagaggatattagaatagatgagattatgcatttcattgatggccctctctatatggaaatagctcaagctgacaatgtttatactgaattaccttttgtggtaaatcaaattaaagttgatggacttacaagtgaagatgaagatgtatccattattcaaggtatgattgatttaatatatgaaagtgacggacaattttactttgttgattacaaaacagatgcttttaatagaagaaaaggtatgagtgatgaagaaatagggaatcagctcaaagaaaaatatcagatacaaatgacgtattatcgaaatactttagaaaccatacttaaacgacccgtaaagggttacttatattttttcaaatttggtacattagaaatagatgat

SEQ ID NO: 444 - protein, 1218 aa, Staphylococcus epidermidis
MIPTKPHDVIWTDAQWQSIYAKGQDILVAAAAGSGKTAVLVERIIQRILRDDVDVDRLLVVTFTNLSAREMKHRVDKRIQEASFKDPNNEHLKNQRIKIHQAQISTLHSFCLKLIQQHYDVLDIDPHFRTSSEAENILLLEQTIDDVLEQHYDKLDPHFIELTEQLSSDRNDDQFRSIIKQLYFFSIANPQPFEWLNQLAQPYKEENKQQQLMQLINDLAMIFMKAGYEELQKSYDLFSMMESVDKQLEVIETERMFITKAIEGKVLNTDVITQHEFMSRFPAINSKIKEANEGMEDALNEAKQHYDKYKSLVMKVKNDYFSRNAEDLQRDMQQLAPRVAYLAQIVQDVIQSFGVQKRSRNILDFSDYEHFALRILTNEDGSPSRIAETYREHFKEILVDEYQDTNRVQEKILSCIKTGEEHDGNLFMVGDVKQSIYKFRQADPSLFIEKYNRFSSSGNESGLRIDLSQNFRSRQEVLSTTNYLFKHMMDEQVGEISYDDAAQLYFGAPYDEVSHPVQLRALVEASSENSDLTGSEQEANYIVEQVKDIINHQNVYDMKTGQYRKATYKDIVILERSFGQARNLQQAFKNNDIPFHVNSKEGYFEQTEVRLVLSFLRTIDNPLQDIYLVGLMRSVIYQFTEEELAEIRVVSPHDDYFYQSIKNYMIDEKADSRLVDKLNRFIQDIQKYQNYSQSQPVYQLIDKFYNDHFVIQYFSGLIGGKGRRANLYGLFNKAVEFENSSFRGLFQFIRFIDELIDRKKDFGEENVVGPNDNVVRMMTIHSSKGLEFPFVIYSGLSKKFNKGDLNAPVILNQQYGLGMDYFDVNKDMAFPSLASVAYRAINEKELISEEMRLIYVALTRAKEQLILVGRVKDEKSLIKYEQLAVSDTHIAVNERLTATNPFVLIYGVLAKHQSPSLPNDQRFERDIDQLNSEVKPRVSIVIDHYEDVSTEEVVNDNEIRTIEELKAINTGNEDVKIKIHQQLSYDYPFKVNTMKPSKQSVSELKRQLETEESNTNYDRVRQYRIGVASYERPKFLTQTKKRKANEIGTLMHTVMQHLPFREQRLTKDELFQYIDRLIDKQLIDEDAKEDIRIDEIMHFIDGPLYMEIAQADNVYTELPFVVNQIKVDGLTSEDEDVSIIQGMIDLIYESDGQFYFVDYKTDAFNRRKGMSDEEIGNQLKEKYQIQMTYYRNTLETILKRPVKGYLYFFKFGTLEIDD

SEQ ID NO: 445 - DNA, 213 bp, Staphylococcus epidermidis
ctgtaccatcaaatggtgctacaatttctcctgaatctggtacaaatccgataccatcacccatcatcttttcagagaaaactttatcaggtacttcagataacggtattatctcaccatgtccaggtgcgtaaatttctgtttctacaatatcttccacatgtacaggatcatctgacacttcttcatcaattgttgtttcacttggttttg

SEQ ID NO: 446 - protein, 71 aa, Staphylococcus epidermidis
LYHQMVLQFLLNLVQIRYHHPSSFQRKLYQVLQITVLSHHVQVRKFLFLQYLPHVQDHLTLLHQLLFHLVL

SEQ ID NO: 447 - DNA, 204 bp, Staphylococcus epidermidis
cgcatactttggtcatcactatgcgtaatccacaaaatggcaatccctttatctgctagtttaaatataatttcttcaattttctttttattatgtgtatctaaagcgctagtagcttcgtccaataataaaacttcaggttcatacatgagttgtctagcgatggtaatacgttgttgctctcccccagacatgtgctcaatt

SEQ ID NO: 448 - protein, 68 aa, Staphylococcus epidermidis
RILWSSLCVIHKMAIPLSASLNIISSIFFLLCVSKALVASSNNKTSGSYMSCLAMVIRCCSPPDMCSI

SEQ ID NO: 449 - DNA, 327 bp, Staphylococcus epidermidis
tcacgtactttacgcgctctactcttaatactccaaacaggcatgatgtgtggtttgttatggtcatcatctgaaatcataataaaattcttttcacctttgtttgtcaatccgtatacttcgtcatattttgcgacatctttaataaactctctcattcttatatcatctaattcagacatcaactcatcagtcattttaactatatctacaatgtttccttcttcaccattattcacattaactaaaactttgtcacctggatcaaagatttcatccatttcatatgttacaaaacggtcaatatctgctctaatgattttgtcg

SEQ ID NO: 450 - protein, 109 aa, Staphylococcus epidermidis
SRTLRALLLILQTGMMCGLLWSSSEIIIKFFSPLFVNPYTSSYFATSLINSLILISSNSDINSSVILTISTMFPSSPLFTLTKTLSPGSKISSISYVTKRSISALMILS

SEQ ID NO: 451 - DNA, 141 bp, Staphylococcus epidermidis
gcaggatttttgactaaagcagtacttaaatcaacttcatctctgtcatcaaacacttcttctacgacttctttacgtgcaatcactctaaatgaaccttcgtccatatttaattctactcttacatttctggcactatca

SEQ ID NO: 452 - protein, 47 aa, Staphylococcus epidermidis
AGFLTKAVLKSTSSLSSNTSSTTSLRAITLNEPSSIFNSTLTFLALS

SEQ ID NO: 453 - DNA, 180 bp, Staphylococcus epidermidis
tatttctttataagctttttaattagactaatatcatgctcattgattaccgaaacaatttcgatttgtccatttttagatataattgagccattaccaccaatcaaggtatcatccgcaaattcaggaatgactggaagcaagtctctaatgggacgtgctgatgcaaacattacattg

SEQ ID NO: 454 - protein, 60 aa, Staphylococcus epidermidis
YFFISFLIRLISCSLITETISICPFLDIIEPLPPIKVSSANSGMTGSKSLMGRADANITL

SEQ ID NO: 455 - DNA, 282 bp, Staphylococcus epidermidis
ttatcttcttctaaagctttaccttcaacgtcaacgtttggcaatactgcacctaaccatttaggaaggtaccatgaagctttaccaaagagtttcgtcaatgctggaattaatgtcatacgtacgacgaatgcgtcgaataacacaccgaaacctaatgcgatacccattgacttaattgcactgtcatcttggaagacgaatgcgatgaatacactgaacataataagtgcagcagctacgataacaggtccactttctttgatacctacacggattgaa

SEQ ID NO: 456 - protein, 94 aa, Staphylococcus epidermidis
LSSSKALPSTSTFGNTAPNHLGRYHEALPKSFVNAGINVIRTTNASNNTPKPNAIPIDLIALSSWKTNAMNTLNIISAAATITGPLSLIPTRIE

SEQ ID NO: 457 - DNA, 303 bp, Staphylococcus epidermidis
tcatcaactgcttgcattaagtctaagattttttgttcgtattcagcatcgccttctaatgcttttaatgcagaaccagcgattacaggtacatcgtcacctgggaagtcatattcgcttaataagtcacgaacttccatttcaactaattctaataattcttcgtcgtctaccatgtcaactttgtttaagaatacaactaatgctggtacaccaacgttacgtgataataagatgtgttcacgagtttgtggcattggaccgtcagcagcagatacaactaagataccgccgtccatttga

SEQ ID NO: 458 - protein, 100 aa, Staphylococcus epidermidis
SSTACIKSKIFCSYSASPSNAFNAEPAITGTSSPGKSYSLNKSRTSISTNSNNSSSSTMSTLFKNTTNAGTPTLRDNKMCSRVCGIGPSAADTTKIPPSI

SEQ ID NO: 459 - DNA, 120 bp, Staphylococcus epidermidis
ttagaaccacctacacgacgagctttaacttctaatactggcatgatattattaattgcttcttcgaacacttctaatgcatcacgaccactacgttgttcaacaagatcaaatgcagaa

SEQ ID NO: 460 - protein, 40 aa, Staphylococcus epidermidis
LEPPTRRALTSNTGMILLIASSNTSNASRPLRCSTRSNAE

SEQ ID NO: 461 - DNA, 84 bp, Staphylococcus epidermidis
aggaggcgaccgccccagtcaaactgcccgcctgacactgtctcccaccacgataagtggtgcgggttagaaagccaacacagc

SEQ ID NO: 462 - protein, 28 aa, Staphylococcus epidermidis
RRRPPQSNCPPDTVSHHDKWCGLESQHS

SEQ ID NO: 463 - DNA, 186 bp, Staphylococcus aureus
tgtgctattattccccctattgaaggacctaacccttcacctaaagctacaattgatcctataaaaccaaaggctttgccttgtttttttcttgtaatatttctagctacaaccaccataatcagtgaagggaatgcagcagatcctactccttgtactaacctaccaaaaatcaaaataaaaaag

SEQ ID NO: 464 - DNA, 210 bp, Staphylococcus aureus
gccagtcacttctcgttccatttgattcaatacaaacaaattatcttgaacatcttccgaagcactgtcgccagtatcttgcttttcttttgcttgttgtttatgatttattttcgcacggtcaaattttttcttaactttctcattattaatgatttttgcttttacatggcattcaaccggaaaaggcatattttgagctttctcaaa

SEQ ID NO: 465 - DNA, 501 bp, Staphylococcus aureus
tgtcgtattaatactgccttcaccagtattgctagcatttggatcttgagtttgtgcgtttgctgctacaggtgctgctggttgcgctgctgctggagcattcgctggctgtgtttgatttgccggtgttgcattattattaggtgttgcttggttatttccttgacctgcttggtttgccggtgttgcttgatttccaggttgtgcttgtgcagcgttattcggatcagcttgattaccttgtccagctggttgtgtatttggttgtgctgctcctcctgctggattagcctgtccaccttggtttgctggttgtactgctggttgtccttggttggcaggtgcagctggctgtgctgtaggattagcttgagcaccagcatttgcgttaggctgtgtattggcatcagctggttgtgctggttgattttgtgcaggctgattttgctctgctgcagacgctgttgtcgggttagtagatataaaagtaacagtggcaat

SEQ ID NO: 466 - DNA, 159 bp, Staphylococcus aureus
atccaacgtttcaggaataaatgttttcaaaccactttgaaatggatcgcggtgttgtgcttgatatactttgtagcgataacgtttacctacacaatcataacgacaatgaaaatcgtcatcgactgtaactacattgttgacataaatatcatcagg

SEQ ID NO: 467 - DNA, 126 bp, Staphylococcus aureus
cggtataaaggtaaagcaaaatgcatcagcttgcttagaatgattgtcctttttttgataatagcgttccattgcaatgacggcagaaggatggtttgcaaacaaatgatttgtatattcactttc

SEQ ID NO: 468 - DNA, 567 bp, Staphylococcus aureus; identical to SEQ ID NO: 171

SEQ ID NO: 469 - DNA, 60 bp, Staphylococcus aureus
atgctaactactttcgctgttgtactcattttcttcttacttccatcttcatttttattg

SEQ ID NO: 470 - DNA, 78 bp, Staphylococcus aureus
ttgagcatctgcatcattattatcattcatgcgatcatttttgttcacattattaaaaatggcattcaaaataacaat

SEQ ID NO: 471 - DNA, 123 bp, Staphylococcus aureus
ttgcctataccaagtactagaagtgcaccaataattccagcaatcaatgcaacgatgactgttttaaaccatggaaatttaggtcttctgtatctaggtgtttggctatggtttgttgtagaa

SEQ ID NO: 472 - DNA, 117 bp, Staphylococcus aureus
atgcttttgagttacttcataatactcatcagttttttgtgtatccttttgacttttatttatttctttccacttaccagtatgactttctttttttacagttattttcggtttgtt

SEQ ID NO: 473 - DNA, 96 bp, Staphylococcus aureus
atgacttgtgaaaaactggaaaatttcttgaccagtagcaaagccggcaccaacgacaacaccaacaaaggcaaatgccacaataatggactcttt

SEQ ID NO: 474 - DNA, 135 bp, Staphylococcus aureus
ttgattgtcattagtaacgttattgccattattttgatttttatctgttttgtctgcactatcatcttgttgatcattttcttcggtttctgtctttttatgcgtagatttattttcttgttcttggttattact

SEQ ID NO: 475 - DNA, 63 bp, Staphylococcus aureus
atgtgcagaaattgcccagcattcaccagttgtttcattagggatatcatagttaaatgcttt

SEQ ID NO: 476 - DNA, 102 bp, Staphylococcus aureus
gtggtatacaacgcaacgtatatgcatcttgtacacgtatttctgattgtcgcgtcgttaatgttgatccttctaaccaatcacgcatacgcgctgccacat

SEQ ID NO: 477 - DNA, 72 bp, Staphylococcus aureus
gtgacaaatatcacactaaacagtgcatttgcagatgctacgataagcgtatttttataccaagtcaggtat

SEQ ID NO: 478 - DNA, 138 bp, Staphylococcus aureus
ttgtgcagtagtagcttggttactattcttaagcttttgttctgcatctctcaactgtttaagtttttgatacgcatcttgtttacgttgatttgtacgtttatattgattttcagcttttttaagttctgtattcga

SEQ ID NO: 479 - DNA, 147 bp, Staphylococcus aureus
ttgccttcttgtttatattgttcaacaagtgctttatgcttagcggactgcttctgtactgcgtcacttgctctttttagttgtgcagtagtagcttggttactattcttaagcttttgttctgcatctctcaactgtttaagtttt

SEQ ID NO: 480 - protein, 62 aa, Staphylococcus aureus
CAIIPPIEGPNPSPKATIDPIKPKALPCFFLVIFLATTTIISEGNAADPTPCTNLPKIKIKK

SEQ ID NO: 481 - protein, 70 aa, Staphylococcus aureus
ASHFSFHLIQYKQIILNIFRSTVASILLFFCLLFMIYFRTVKFFLNFLIINDFCFYMAFNRKRHILSFLK

SEQ ID NO: 482 - protein, 167 aa, Staphylococcus aureus
CRINTAFTSIASIWILSLCVCCYRCCWLRCCWSIRWLCLICRCCIIIRCCLVISLTCLVCRCCLISRLCLCSVIRISLITLSSWLCIWLCCSSCWISLSTLVCWLYCWLSLVGRCSWLCCRISLSTSICVRLCIGISWLCWLILCRLILLCCRRCCRVSRYKSNSGN

SEQ ID NO: 483 - protein, 53 aa, Staphylococcus aureus
IQRFRNKCFQTTLKWIAVLCLIYFVAITFTYTIITTMKIVIDCNYIVDINIIR

SEQ ID NO: 484 - protein, 42 aa, Staphylococcus aureus
RYKGKAKCISLLRMIVLFLIIAFHCNDGRRMVCKQMICIFTF

SEQ ID NO: 485 - protein, 189 aa, Staphylococcus aureus; identical to SEQ ID NO: 172

SEQ ID NO: 486 - protein, 20 aa, Staphylococcus aureus
MLTTFAVVLIFFLLPSSFLL

SEQ ID NO: 487 - protein, 26 aa, Staphylococcus aureus
LSICIIIIIHAIIFVHIIKNGIQNNN

SEQ ID NO: 488 - protein, 41 aa, Staphylococcus aureus
LPIPSTRSAPIIPAINATMTVLNHGNLGLLYLGVWLWFVVE

SEQ ID NO: 489 - protein, 39 aa, Staphylococcus aureus
MLLSYFIILISFLCILLTFIYFFPLTSMTFFFYSYFRFV

SEQ ID NO: 490 - protein, 32 aa, Staphylococcus aureus
MTCEKLENFLTSSKAGTNDNTNKGKCHNNGLF

SEQ ID NO: 491 - protein, 45 aa, Staphylococcus aureus
LIVISNVIAIILIFICFVCTIILLIIFFGFCLFMRRFIFLFLVIT

SEQ ID NO: 492 - protein, 21 aa, Staphylococcus aureus
MCRNCPAFTSCFIRDIIVKCF

SEQ ID NO: 493 - protein, 34 aa, Staphylococcus aureus
VVYNATYMHLVHVFLIVASLMLILLTNHAYALPH

SEQ ID NO: 494 - protein, 24 aa, Staphylococcus aureus
VTNITLNSAFADATISVFLYQVRY

SEQ ID NO: 495 - protein, 46 aa, Staphylococcus aureus
LCSSSLVTILKLLFCISQLFKFLIRILFTLICTFILIFSFFKFCIR

SEQ ID NO: 496 - protein, 49 aa, Staphylococcus aureus
LPSCLYCSTSALCLADCFCTASLALFSCAVVAWLLFLSFCSASLNCLSF

SEQ ID NO: 497 - DNA, 165 bp, Staphylococcus epidermidis
caagtgctgaaaatgcttcagaacatcctcttgctgatgctattgttacttatgctaaagataaaggtcttaatttacttgataatgacacttttaaatcaattccgggacatggtattaaagctacgattcatcaacaacaaatccttgtgggcaatcgaaaat

SEQ ID NO: 498 - DNA, 156 bp, Staphylococcus epidermidis
aagaggcttgttatgcagcaacacctgcaattcaacttgccaaagattatcttgctcaacgccctaacgaaaaggttcttgtcattgctagtgacacagctcgttatggtattcattctggtggtgagcctactcaaggtgccggtgcagttgcaa

SEQ ID NO: 499 - DNA, 96 bp, Staphylococcus epidermidis
ctgcgcctacgccagtttcagctattatgcacgctggtattgttaatgctggtggcgttattcttacacgcttttctccggtatttaatgacgaaa

SEQ ID NO: 500 - DNA, 87 bp, Staphylococcus epidermidis
cgtttacgatatacttcatacatcattaaacttgcagccacagacgcgttcaagctattgacatgtccaaccattggaatcttaata

SEQ ID NO: 501 - DNA, 210 bp, Staphylococcus epidermidis
tcaagcgtttttgctatacgacttactatcactttttctcgattttcaaatgttggatgcaaaaaacatatcaagggagccataataatgaagaaagaaataatagaatggattgtagccataatcgttgcaattgttatcgtcacacttgtgcaaaagtttttatttgcttcttatacagtcaaaggagcatctaatgtcatttatcac

SEQ ID NO: 502 - DNA, 93 bp, Staphylococcus epidermidis
agatctgtaccacatattgtcgtcttaactatgcgaataatagcgtcagtactgctcgtaatagttggcttctctttatccgtaagttgtgca

SEQ ID NO: 503 - DNA, 291 bp, Staphylococcus epidermidis
actgccaataatatcatcagcttcataattacgcttaccaacatttacaaaaccaaactgatgggatatttctttaacataatcgaattgaggaataagttcatcaggaggtgctgggcgattttgtttatagccatcatacatttcatttctgaatgtttcttgccccatatcccaacaaactgctacgtgagtaggttcgatttccttgatagcgctaaaaatatgtcttacaaaaccttgaataccatttgtaggaattcctttagaattgtacataaattgattgtg

SEQ ID NO: 504 - DNA, 111 bp, Staphylococcus epidermidis
ttcttttgtagattgactcaactcaactggctcaaatacttgtccgttagaatgctttacatgtattttatgattttcagtataatgaatcatattgtaagtaccatttgt

SEQ ID NO: 505 - DNA, 93 bp, Staphylococcus epidermidis
atttttatatctacatgcgggtgtagtacaacatcagcttggaaggctgaggttttgccattaagggttcgattcccatcacccgctccattt

SEQ ID NO: 506 - DNA, 132 bp, Staphylococcus epidermidis
ctaaagaatatattgaggattgtatttattgctggtttgacagttttcttctctggtcctggccaaacttattcaaacgcagcatttattgatgaatatattcaaacatttggatggagccgtacagaagtt

SEQ ID NO: 507 - DNA, 155 bp, Staphylococcus epidermidis
aggaattccaatcaaatgtaccaaacatttacagcggatattgtacttatatttatgattattgtacttggaggacttgtagttcaagttccaatgccaattttagcaggtattatggttatggtttctgagacaatctactgtttgcacctgat

SEQ ID NO: 508 - DNA, 51 bp, Staphylococcus epidermidis
aatcaacgactcgaggaaacaatttcctctccccatcacagctcagcctta

SEQ ID NO: 509 - DNA, 1299 bp, Staphylococcus epidermidis
atgaaacaatttttaaacatcactcaacgtaaatttatcgaatggttgattatcttatccatttttatagttagcattcctaataaatggacattaatgatatctatcgctttatctttattacttcttaaaagaggggcgctaggtgtcgttcaattaatcatactttatatgctcagatcgcaaatatacaccccatatgatacacaagagatggcgcattacatagtaagtatgaaatatatcttgatttatgtaattggagtattttttctatttaaatatgtaaaacattggataagaaatgaaatgatattaagatttatcaagtctactatgattcttatgctactttatatcataatgagtttagtcgtatctaatgatccgatagaatctattcttaaattgcttaacttctttataccgctaattttgattgttatgtatgttagtttaataaaaaagataaagaatctcattaactggattaatcaatttatcacgctagtgattgcctttacttttttatttatagttatagcgccaaaatcatatttaattgatgaggaatcacttagaagtgttttcaaggatgcacattcattcgcagttattcttgctatgggtctagttctatatatggtaacaataatcaaacaacaagattatgatgtattcaatttattattattaaatattggaatgatagagctctatttatcaaattctcgtcatattttcatatctgttattttatgtctaatgcttctattaccgttatctcacataaaaaagagaattaaacatcccataattggtgctatgatactaatggcaattgctataataaatcaaccatatatttatcatctttttattaaactaatcttaaaagggaagaatagccaagaggtctttatgccgagtgatatgaatattaaagctattgattatgcgctaactgagcatccttttttaggaagcggttttggtataccaatgataaaagcgagttcagaaatacaatactttaatgtagcaacgagtaatatcatcttcggtatgattatctttactggaataataggacttactttatgtacgatatacatgcttcatatggtacttttagttacttttccaatgagtattactattttattatttttaatcactatctttgttaatatggattatattattttatttgattccgtggggctaggtatattgtgttatatattttggggaatatatttaaaagaaggtatgtatcaatacaacaacggacaatgg

SEQ ID NO: 510 - DNA, 1107 bp, Staphylococcus epidermidis
atgacaaatcaaaaaactgtgggtctagtcgtcgctccaggtgttactgaacgccttgcagaaaatctcatacaagaaatgcctaaaatgttatctacacattatgatcatcagcaagaatggatttttgatttagttacggatccgcttactggttttgctgaatctgtagatgaaatttttgggaaagtagccgattatcacgataagagacaatgggattatgtgatagcaattacagatttaccgatgtttgcggacaagcaagtgatggcattagatattaatatggaaaatggtgcagctatattctcatatccggcatttggctggcgtccagttaaaaaacgtttcaagcatgcgatttataatattattcaagaattaaatgaagctgaacaagaaagtcgtaattatgataataataagcaaatagaaaattcagtaaaaaaacaatttccgctctctaaaatagataaagaaacaatatatatgaaagaaacagactcttatcacttaagatatttatcaagttcacgttctagaggcatgtttcgccttgttagtggaatgacctttgcgaataatccattaaatatgatggcaagtttaagtaatatagtagctattgcatttactacaggtgcatttggacttgtatttacaacgatgtggcaaatggcttataacttttcaatgtggcgcttatttggaatttcaattattgcgattattggaatgctaatatggataatgatgtcacatgatttatgggagccagttaataaaagcaaccataagcatattacttggttatacaatcttacaacaataatgacattgatttttgccattataatttattatattattctttatttactattcttaattgctgaaatcgtattattgccatcaggattcttaggtcagcaagttggattgaaaggtcctgcaggcattgatttgtatttaagtattccatggtttgcagcttcaatttctacagttgcaggtgcaataggtgctggtttacttaatgatgaactcattaaagaaagcacatatggatatcgtcagcgtgtaagatacgaagaacaacgtcga

SEQ ID NO: 511 - DNA, 747 bp, Staphylococcus epidermidis
atgaaattctgccctcattgtggaaatccgataaaaaaggaacagtcattttgtaataaatgtggaaaacatttaaagacatcgacacaaagaaaaagtgaaaatcaaattgaacatatgcgtgaacagcaatcgtatatttctcgtgaggaaagacaacatcatgattcaacattttataaagaacaaaaacatactggttggctaattgtattatcaattatatttgtcttgttgatagcagcgctattgtatggtgcgtactatgcttacaatcattatattagtgatgagcaaagtcaccaaacaacagagtctcagcaatcaaatgaaagtgatcaaaatagggaccaatccactggtccaagcattgatgtttttagtgatgactttgatcaaggttatatgaagtcagcttcaacaagtggatatagaggtgtttataatggaatgacacgtgaagaagttgaagataaatttggaacatccaatggttctgtagaaagtttgaagtggagttacgaaacatatggtgatttagctgtagcctacgatgataatgaagttgttagcgtaggtgtagcacctaatcatatttcagaagatcaatttttaagtatgtataatgaaccggatgatagaaattcaagccaactcatttatgatagtaacaaagataatgacttctctgtgttagctaatgttaaaaatggagatgttactgtcattgaaaatgtaaatcaaatt

SEQ ID NO: 512 - DNA, 1296 bp, Staphylococcus epidermidis
atgttattgtttatcatagaaatcataatcatgattctagcgatattattaggattaagaactgctggtgcactgggatgtggcatctttgctatagtagcgcagcttatcatgatatttggattccagttacctccaggttcagcaccagtgacggcagtgttaatcatattatctattggtatagcaggtggtacgttacaagccactggtggtattgactatttagtatacattgcatcacgtgtgattgaacgctttccaaaatcaattatatttatagcgccaatgattgtctttgtctttgtttttggaattggtactgcaaatatagctctttcacttgaacctatcatagcgaaaactgcacaaaaagcacgaattcagcctaaacgcgcattaactgcttcggtacttacagccaatttagccttactttgtagcccggcagcttctgctacagcttatattatttctgtattagcagggtatgaaatatcgatgggcaagtatttaagtattgttttacctacagctttaattagtatgttaatgcttagtacattttgtacatttgtaggacgaaaagaacacgtgcgtgatgagtcagaacgtttagttcagatgccagaagtcgaaatcaaaaatgacttttcattaaaagtaaaaataggtgttatctcattcctattatgtgtcatgggtattttaacgtttggcatatttcctaatctcatgccgcaattcaatgtgaatggagatgtagttaaagttgagatgactgaaattgttcagttctttatgtatctcagcgctacaatcaatttattattaataaaaatcaatacttctgatattctgtcatcgaatattacacaatctgcaatgggagcactttttgcagttcttggcccaggttggttaggtgcaacaatatttaatgctccacataacttaaaaatattgaaaaatgatattgggtcaattattagtgaagtaccttggcttgttatcatacttgtttctgtagttgcaatgattgtcatttctcaaacagctacagcatcaattatggtgccgatagttatgagtttaggtatacctcccatctattttgttgcgatggtacaaacattaaatgtgaatttcgttattccagctcaaccgacactattatttgctgtagaactagatgaaacaggtagaacaagacctacgagctttatgataccaggattttttgttataacagtatccgtcattacaggatttgttattaaaaccattttaggatat

SEQ ID NO: 513 - DNA, 1449 bp, Staphylococcus epidermidis
atgggaagtttttttaatcggatgactcgaaaagagaatcctactatttatcaaaataaagatgggcatcttaagcgcacgttacgtgtacgtgactttcttgcactaggtgttggtacaattgtctctacatctatcttcactttaccaggtgttgtcgcggctgagcatgccggacctgctgtggcattatcattcttattagctgccattgttgcaggtcttgtagcctttacttatgcagaaatggcatctacaatgccttttgctggatcagcttattcatggattaatgtactttttggtgaattattcggatgggttgccggttgggcgcttttagcagaatactttattgctgttgctttcgttgcttcaggcttttctgctaacttaagaggtcttattgcaccattaggcatttctttacctaaatcattatctaatccatttggaagtaacggtggtgtcattgatatcattgctgctgtagtgattattttaactgcattactattatcacgcggaatgaacgaagccgctcgtatggaaaatgtattggttatattaaaggtgttagccatcattttatttgtgattgttgggctaactgcgattaatttcagtaactatataccatttattccagaacataaggttactgaaactggcgactttggaggttggcaaggtatttatgctggagtttcaatgattttcttagcttatattggttttgactctattgctgctaattcagctgaagcgattaatccacagaagacaatgcctagaggaattttagggtcactcatagtagcaattgtattgtttgtggccgtagcacttgttcttgttggcatgttccactactctcaatacgctgataatgcagagccagtaggttgggcattacgagaaagtggtcatggtattattgctgcaattgttcaagcaatttctgtcatcggtatgttcactgcattaatcggtatgatgcttgcaggttcacgtctattatattcatttggacgagatggtttactcccttcttggttaagtcaattgaatcacaaacatttacctaatcgagcacttgtcatacttacaatcattggcgtagttatcggatcaatgttcccgtttgctttcttagcacaattgatttccgcaggtacccttgttgcattcatgtttgtgtcactagcaatgtatcgattaagaaaacgtgaagggaaagatttacctaagccagagtttaaattacctttatatcctattttgcctgcaattacatttatattagtattgctagtattttggggattaagttttgaagctaagttgtatacactgatatggtttattgtaggtataattatttatttaatttatggaattagacattccaaaaagaatgatgaagaagcgtatcaagtacctagagaa

SEQ ID NO: 514 - DNA, 1071 bp, Staphylococcus epidermidis
atgacaaagaaaaaacgtttatcgcctagtgagtggttgcttaaacaatctaaaagacataaaaggaaaaatacactttacacggcaattgtacttttagtagcgttagttctactcatatttgctgttaaatcaatacaagtagaacctgtaaaaagtgatacgagagacaaagatagcattcgtatcacctatttaggtaacgtcactttaaataaacatattcgacaaactaacttgaatgatgtttttaaaggtattcaagatactttagatcatagtgatttttcaacaggttcattaatagtaaatgatttttcaagaaatcaaaaagataacataaataaaaatattgaaaatatcatgtttctacgcaagcataatgttaaaagtgttaacttaatcaacgaatctatggataatattcaagcgacagcaatgatgagaaaaatagattcccaagcaggttataattttttaacaggtaatggttcaaatccaattaatagtaaaactgtacaacaagacattaaaggtaaaaaaatagctaatgtttcatttaccgatatcgaatctaactatactaactctttaaaaaacacgacgtcaattagtttagatccagctatattttatcctttaataaaaaaattaaaggaaaataatgattacgtcgtagtcaatgtagattgggggatacctaatgaacgaaatgtgactacacgtcaaaaagaatatgcacatgcgttagcgaatgctggtgcagatgtcattattggtcataatacagttattcaaaaagttgaaaattataagcgaacgcctattttttatagtttaggtaacacaacgtctgataacttcttatcaaaaaatcagaaaggaatgattgtacaacaagactggaaaggttcgcataatcagttccatatcacaccaattcaatcaaaagatggaaaaatctctaaagataatatgaataaaatggatcatattcgattcaaaaataacattaaagataaatcaattgatttaaaatctgatcaaaatggaggttatacttttgaatat

SEQ ID NO: 515 - DNA, 699 bp, Staphylococcus epidermidis
atgattgaacatttaggaattaatacaccttattttgggatattagtatcattaataccatttgtcatagcgacttatttttataaaaaaacgaatggtttctttttactagcacctttattcgtaagtatggttgcaggtattgcttttttgaaattgacaggaattagttatgagaattataaaatcggtggcgacattattaatttcttcctagaaccagctacaatatgctttgcgattcctttatatcgcaagcgcgaagtattaaaaaaatattggttacaaatatttggtggtatagctgttggtacaattattgccttgttattaatttatcttgttgcaataacattccaatttggcaatcaaattatagcatctatgctacctcaagctgcaacgacagcaattgcattacctgtatctgacggtatcggtggtgtcaaagaattaacctcactcgcagttattttaaatgcagttgtcatttctgctttaggtgctaaaatagttaaattatttaaaatatctaaccctattgccagaggacttgcactagggacaagtggacacactttaggtgtcgcggcagctaaagaattgggtgagactgaagaatcaatgggaagtattgcagttgtcatcgttggcgttattgttgtagcagtagttcctatacttgctccaatcttatta

SEQ ID NO: 516 - DNA, 699 bp, Staphylococcus epidermidis
atgaaaagaacagataaatatagagattcatacaaatatgatgaccaatatcaaaatcatcgtaaacgttcagaagaagatatgtatcgacaacatcaagagtcccaacagagagcaaattcaaatcgtgcaacacaaagtgaaaatgatagagagtatgaaaatcatcctgaacgttattacaatggaagagactatcgacgtgagcagcaattggaagaagaaaatgaaaaatcaagcaaaactaaaaaatggctgattgcaatcatagttattttactcattattgtagctatctttatcacgcgtgcaattatcaatcataataatgataaagtaagtaatgaccctaacgtttcacaaaactataaaaaggaagttgaaaatcaaaacgacgacattaatcgacaagttgattcagccaaaagcgatataaaaaataaaaaggacacccaatcccaaattgataaactacaaaatcaaattgatcaattaaaacaaaatgaagaaactaatgcggattctaaattcacaaaattttatcaaaaccaaatcgacaaactgaaaaatgcaaataacgctcaacttaataacgaaaatcaaagtaaagttaacaacatgcttgaagacatcaatacaaaatttgatagtattaaagctaaactagaaaatatcttgaatggatcaaattcaggaaac

SEQ ID NO: 517 - DNA, 1161 bp, Staphylococcus epidermidis
atgaacatgaaaaagggtgtttctcagcttacgttacagacattgagtttggtcgcaggctttatggcatggagtatcatttctccattaatgccatttatttcacaagatgttgatatttctccaggacaaatatctgtcattttagctattcctgttattttaggttctgtactacgtgtaccatttgggtacttaactaacattgtaggagcgaaatgggtgtttttctggagttttattgtactattacttccaatttttcttttaggtcaagctcaatcacccggtatgctaatgttatcaggattctttctaggaattggtggcgcaattttttcagtaggtgttacttcagtacctaaatacttttcaaaagacaaagttggtttagcaaatggtatatatggtgtaggtaatattggtactgcagtttcatcattttgtgccccagtgttagcaggtgcaattggctggcaaaatacagttcgtagttatttaattattctaagtatatttgcaattttaatgttttttttaggagataaaaatgagccgaaagtgaagattcctttgatggctcaagtcaaagacctatctaagaattataagttgtattatttaagtttgtggtattttattacttttggagcttttgtggcttttgggatttttttaccgaactttctagttgatcattttagtattgataaagtggatgcaggtattcgttcaggtatatttatagcactagcgacgttcttaagaccggttggtggtgttataggtgataaatttaatgcagtacaagcgcttatcatcgacttcgtgataatgattattggtgcgcttatattaagcttatctagtcatattgttctgtttacgataggctgtttagcaattagtatctgtgcaggtataggtaatggtttaatatttaaattagcaccttcatacttttctaaagaagcaggttcagcgaatggtattgtatccatgatgggaggactaggcggtttcttcccaccactggtgattacttttgtaacgagtatcactggttcaagtcatctcgctttcttcttcttggctatatttggtgtaattgctcttattacaatgattcatttaaataaaaaagagaaagctattcgtata

SEQ ID NO: 518 - DNA, 348 bp, Staphylococcus epidermidis
atgaaaaataaaaaaggattaggcataggtcttatcacaattatgattatcgtttgtattgtactagtaatcatgatgttcgtgggtggtaagaaagaatcatactacggtattatgaaagatagcacgactattgataaaatgataaatactaaaaatgaaaaaattgaaaaaaacgtagaattacctaaagatgctaatgtatcagttaaaaaagaagattttgtgatgctctttaaagatgaaaaaactggaaaaattactaaagttaagaaagttaatcacgatgacgtacctcatggtttaatgtcaaaaatccatgatatgggtaatatgaaacacggaatg

SEQ ID NO: 519 - DNA, 642 bp, Staphylococcus epidermidis
atggctatgtcattactcgtgagtcttgtggtttatatgatgacactcacatctgatatattagaagatattctatcatttaaattagaagtgataatgcaatttccgtatatattaagctctatttcactaatcattttgtttatacttttcattttaaaagatatggaaaaaatatggtactggctcatttcaatagttatgattgctgtgataagtatgtctggacacgtgtggtcacaacaagtgccattatggtcaattatcataagaacaattcatcttatagggctaacgttatggttaggttcactcgtttatctcatttgttatgctattaaagtgaaaattaatcagttgacgagtgtaagacgtatgcttttaaaagttaatatcattgctgtgattatgctcgtttttacagggattttaatggctattgatgaaacgaatactttaacactttggaataatgtgagcgcttggtctatttatcttgtcataaaaatcgcaggaattattgctatgatgctattaggtttctatcaaacgatgcgtgctttgagacaacgacaacaggtccatcgttttgcactgatgactgaattgttaattggtatgatattaattttgcaggtatca

SEQ ID NO: 520 - DNA, 1146 bp, Staphylococcus epidermidis
atgaaaaactctagattttctgggttccaatgggctatgatggtctttgtatttttcgttatcacaatggcattgtccgtgatactcagagattttcaagcgactatcggagtgaaacgttttgtctttagtattaaagatttagctcctttcatagctgcaattgtgtgcatattagtatttaagcacagaaaagaacaattagcaggattgaaattttctatcagtttaaaagtgattgagcgtctacttttagcactcattctaccacttatcattttaatgattggcttgtttagctttaatacttatgctgatagtttcatcctattacaaacttcagatttatcagtatcattattaactatattaattggtcatattttaatggcttttgtagtggagtttggtttccgttcttacttacaaaatattcttgaaacaagaatgaacacattttttgcgagtattgtcgttggtcttatttattcagtatttacagctaacacgacatatggtgtagaatacgccggataccatttcttatatacattcatgttttcaatgattattggtgaattaattagagctactaatggtcgtacaatttatattgcaactgcttttcacgcatccatgacttttgctctcgtctttttatttagtgaagaaacaggcgaccttttctcaatgaaagtcatcgcactttctacaacaattgtgggtgtttcatttattattattagtctaatcattcgtgctattgtttataaaacgacgaaacaaagtttagacgaagttgatcctaataattatttatctcatattcaagatgaagaaccaagtcaagaagacgcctcttcaacttcaaatcatgatgtatcatctaaagatgaaacaaagcaacaagatattgataatgacaaacatcaatcaaagaaacctaataagagtgacgatgcacttactacttctaattataaagaagacgcctcttcagttaataaagaaacggatacaactcacaatgataacattaaagatcattcaacttataccgaagatagacactcatctgttgtcaacgatgttaaagatgaaattcacgaagttgaagatcataaagccgacacagataaatcacat

SEQ ID NO: 521 - DNA, 1374 bp, Staphylococcus epidermidis
atggaaaataatgagttgcaaaggggattgaatgcacgtcagatgcagatgattgctcttggtggaacaattggtgttggtctttttatgggagcaacaagcacaattaagtggacaggtccatcagttattcttgcatatttaattgctggtatttttttatttttaatcatgagagccatgggtgaaatgatatatattaatccaaccactggttcttttgcgacgtttgctagtgactatattcatccagcagctggctacatgactgcttggagcaatgtatttcaatgggttgtcgtcggcatgagtgaagtgattgcagtaggagaatatatgaactactggttcccaagccttcctaattggataccaggagtgatagcagttctctttttgatggctgctaacctagtttcagtaaaagcgtttggagagtttgaattttggtttgccttaattaaagttgtaactattgtattaatgattattgcaggattaggattaattttatttggtataggcaatggagggaatccaatagggatttctaacttatggtcacatggtggatttatgccaaatggattcattggatttttctttgctttatctattgtgattggatcataccaaggtgttgaattgattggcatctcagcaggtgaaaccaaaaatcctcaaacaaatattgtaaaggcagtcaacggagtgatatggagaattttaattttctatattggtgcaatttttgtcattgtatcagtatatccttggaaccaattaggtagtattggtagtccttttgttgcaacgtttgctaaagtgggcattacgtttgctgctggtttaataaactttgtagtcttaacagcagcattgtctggttgtaattcaggtatttttagtgcaagtcgaatgatttatactttggcaaaaaaaggacaaatgcctaaagtatttactaaagtaatgaaaaatggcgtacctttctacactgtatttgcagtatctatgggaatattaattggtgctttattaaatgttatacttccattaattattgatggagctgatagtatctttgtatatgtatatagtgcctctattttaccgggaatgataccttggtttatgattttatttagtcatctaagatttagaaggttacatcctgaaaaggttcacaatcatccttttaaaatgccgggaggggcaattgccaattatttaactatcatgtttttactcctagtattagtcggtatgttacttaacaaagaaactgtagtatcggttgttattggtatcgtgtttttaacagctgtgacactttattatcttattagatatcacaaaaaggaacgacaaata

SEQ ID NO: 522 - DNA, 534 bp, Staphylococcus epidermidis
gtgaaaagacttaagaattttattctcggcttactcattgtggctatagttggcttcctattatttatgtatatagatgatagtcgcattcaaagttatcaagactacttcttacaatttaattggttccaaccactattgattgggcttgcaggattacttatattaatcggacttatattagtacttagtatttttaaacctacgcatcgcaaacctggactttataaaaactttgatgatggacatatttacgtatcacgtaaagctgttgaaaaaacaatttacgatacaatcgctaaatatgatcaagttagacaaccaaatgttgtaagtaagctttataacaaaaagaataaatcatttattgacatcaaagcagatttcttcgtaccaaaccatgttcaagttaagagtttaacagagagtatccgtgctgatatcaaaagtaatgttgaacactttactgaaattcctgttagaaaattagaagttaacgtacgtgatcagaaaacatctggtccacgtgtattg

SEQ ID NO: 523 - DNA, 1455 bp, Staphylococcus epidermidis
ttgcaagattttgataacttaattcctggctggtttaaaacatttgttcaagtcgggaatgacttaatttggtctcaatatcttattggattattattaacagcaggttttttctttacaattagttctaaatttattcaactcagaatgttaccagagatgtttagagcattaactgaaaagccagaaactttaagtagtggtgagaagggtatttcaccatttcaagcttttgcgattagtgctgggtcaagagtaggaactggaaatattgccggtgttgcaactgctattgttcttggtggccccggtgcagtcttctggatgtggattattgcttttattggtgcagctagtgcatttatggaagcaacgcttgctcaagtttataaggtacatgacaaagaaggtggattccgtggcggaccagcctattacataacaaaagggctaaaccaaaaatggcttggaattgtatttgctgttttaattacagttacatttgcttttgtatttaatactgttcaagcgaatacaattgctgaatcattaaatacacaatacaatattagcccggtaattactggaatagtacttgcagttattacaggtattatcatctttggtggtgttcgtagcatagctacactatcttcacttattgtgcctattatggctattgtttatataggtatggttttaatcattttattactcaatatagatcaaattgtacctatgattggcactattattaaaagtgcattcggagttcagcaggttactggtggtgctgtaggagctgctattcttcaaggtattaaacgtggtttattctcaaacgaagctggtatgggatctgcacctaatgctgctgctacatctgctgtgccccatcccgttaaacaaggtttaattcaatcattaggtgtattctttgacactatgcttgtttgtacagctacagcaattatgattttattatattctggtttgcaatttggtgatagcgcgcctcaaggtgtagcagttacgcaatcagcgttgaacgaacatttaggttcagcaggaggtattttcttaactgtagcagttaccttatttgcattttcatctgttgtaggtaactattactatggacaatccaatattgaatttttatctaacaataagatgatattatttatttttagatgttttgtagtacttttagtatttgtaggtgctgttgctaaaacagaaacagtttggagtactgccgatttatttatgggtcttatggcaatagtaaatatcatatcaattataggtttgtcgaatattgcgtttgcagtgatgaaagattatcaaagacagcgtaaagaaggtaagagacctgtgtttaaacccgaaaacttagaaataaatttatttggcattgagacttggggacaacatgcaaaaatgccaaaaaaa

SEQ ID NO: 524 - DNA, 573 bp, Staphylococcus epidermidis
ttgaaaaaagaaattttagagtggattgttgccatagccgttgccattgcacttattgccataatcactaaatttgtcggaaaatcatattctattaaaggtgattcaatggatcctacattaaaagatggggagcgtgtagtggtaaatattattggctataaattaggtggcgttgaaaaaggaaatgtcattgtatttcatgctaataaaaaagatgattatgttaaaagagttattggaactccaggagatagtgttgaatataaaaatgatacactctatgttaatggtaaaaagcaatcagaaccatacttgaactataatgaaaaacgtaagcaaactgagtatatcacaggtagtttcaaaacaaaaaatttaccaaatgctaatcctcaatctaatgttattcctaaaggtaaatatttagttttgggggataaccgtgaggtaagtaaagatagtcgttcattcggtttaattgacaaagaccaaattgttggaaaggtatcgctcagatattggcctttcagtgaatttaaatctaactttaatccaaataacactaaaaat

SEQ ID NO: 525 - DNA, 1083 bp, Staphylococcus epidermidis
atgttcaataaggtttggtttagaacaggaatattttttattatgctgttcatactcatcaaactatttatggaagtgcatgaagtatttgctccaatagctactatcattggttcagtcttccttccatttttaattagtggatttctcttttacatatgtttaccttttcaaaacatattagaaaagtggggctttccacgttgggctagtataacaacaatattcataggattaatagctatcatcgctattgtggtatcatttatagcacctatcattatttccaatattaataacttaattaaacaaacaccatcattacaaaaagaagccgaacaattaattaatttctcgttaagacaaatggataaattaccagatgatgtcacacatcgtattaataaagcggttaaatccatgggagatggcgcaacgtctattttatctaattcagtgtcatatattacgtctttcatctcaactgtatttttattaataatggtgcctttcttcctgatatatatgctaaaagatcatgaaaaatttatcccagcaatcggtaaatttttcaaaggagaacgtaaagtttttgttgtagatttattaaaagacttaaacttcactttaaaatcatatattcaaggtcaagtgacagttagtatcatcttaggtattattttatatataggttatacgattataggattaccatatacacctttattagtattattcgccggcgtagctaacttaataccatttttaggtccatggttatcttttgcaccggcagcgatactaggtattattgatggcccttcaacttttatttgggtatgtgtcgtaacattaatcgcacaacaacttgaaggtaacgtgataactcctaacgtaatgggtaaatcattaagcattcatccattaactattattgttgtcatacttgcagctggagatttgggtggtttcacactcattcttgttgcagttccattatacgctgtaatcaaaacattagtgagcaacatttttaaatatcgtcaacgtattgtcgataaagcaaatagtaatgttaaagat

SEQ ID NO: 526 - DNA, 288 bp, Staphylococcus epidermidis
atgaatacaatcgtaaaacatacagtaggttttattgcttctatcgtactaacgcttttagcagtttttgtaactctatacactaatatgacattccatgctaaggtaactatcatctttggttttgctttcattcaagctgcccttcaattattaatgttcatgcatttaactgaaggtaaagatggacgtttacaatcgttcaaagttatctttgcaattatcattactttagtaactgttatcggaacatactgggtaatgcaaggtggacactcttctcactta

SEQ ID NO: 527 - DNA, 1290 bp, Staphylococcus epidermidis
atgtcttttcttaggaaacacaccgaaattatatttagttatatcatcggtatcgtttcactttttacaggtctcattatttttattaacttacctttaatcaaacaatttaaaggtgacaaaaaggttgatacgcatgtgcataacgtatgggaattcctaaatgccttttttgccgagattataaaagtgatgagtaaatttattggtggctttccaattacaagtgccatagtaatcatcgtatttggtattctagtgatgctgttaggtcacactttatttagaactattaaatacgattatgacatttcaattttctttttagttattggcattatgtactttatcattacattattgctaatgacacaagtgtatggcttttttgctatcgtctttattattccttttacagttcatattggttacatagtttataaagatgagttgaaccaagacaatcgaaagaaccattatatgtggattattgtaacttatggaatgagttatcttattacccaaatttcgctatatggacgtattgacgcaaatgaaattgaatcaattgatattttaagtgtaaatacattcttcattattatgtggttattaggtcagatggctatatggaatttcttattcctaagacgttcattaccactcactaaagaagaattaggcgaagaggaacctgaactttcaagaactaataaaggcaatgtatctaatcaaactaaagttcacttaaaacaactacaaaataagacaaccgagtatgcacgtaagactagaagaagtgttgatttagataaaattagagccaaaagggacaaatttaagcaaaaaattaacagcatagtagatatacaagaggacgatattccaaattggatgaaaaaacctaaatgggttaaacctatgtatgttcaattgttttgtggtgtaattattctgttttttgcttttctagaatttaataatagaaacgcattattcttaactggtgaatgggagttatcacaaacgcaatatgtagttgagtgggtaacattattattgctacttttcattattattatttatattgcaactacattaacttattatttaagggataaatattattatttacaactctttatgggcagtattttattctttaaatttcttacagaatttatcaatattatggtacatggattattattatcaattttcattacgccaatcttattattaatgcttattgcaatgattgttgcttattctttacagttgagagaaaaa

SEQ ID NO: 528 - DNA, 1149 bp, Staphylococcus epidermidis
atgttaggagagcaatatacacaaattaagcgtccagcaaatcggctaactgaaaaaatattaggttggtttagttgggtattcttactcatattaactattgtttcaatgtttattgcgctcgtatcttttagtaatgatacgtcaattgccaatttagaaaacacacttaataataatgaactcgtacaacaaattttagccaataatgatttaagtacaactcaatttgtgatttggttacaaaatggagtttgggcaattattgtttattttattgtttgtttgctcatctcgtttttagcgttaatttctatgaatataagaattttgtctggtttactttttttaatagctgctatagtcacaattccgcttgtattgttgattgtaactctaatcattcctatcttattctttatcattgcaatgatgatgtttgctagaagagatagaatagaaacagtgccatcttattataatgaatatgatcaaccatactatgatgagagaggtttttatgaaccagagtcaagaaatgaacatggatataatgatgatgtgtatgaacctatgcatactaaaaaggaagatagaaatacaagacgtcaattcaatagaaatgctcagcaacaagattcctataatggtataactgataatcaacccgatgaagatacatcttccgatcaactttattcagacgaatatgtagataatgaagataaatattctcaatttccaaaaagagcagttgaaagtgaatatgcatctcaacaaactgaagatgaaccaacagtcatgtcaagacaagctaagtacaataaaaaatctaaaaatacggattttgaagatgcgcaacaggaacatatggaaggtaatcaatttgatgacgtaggagttgttgaaccacaaattgatcctaaagaactaaaagcgcaaagaaaaagagaaaaagcagaaatacgtgctaagaaaaaagaaaagagaaaagcatataataaacgtatgaaagaacgaagaaaaaaccagccaagtgctgttaaccaacgacgtatgaattatgaagaacgtcgacaaatgattaataatgaacaagaagatacagataataacttaaatcaacaggaagattcaaaaaaagaaaat

SEQ ID NO: 529 - DNA, 1389 bp, Staphylococcus epidermidis
atggaagagaataaaaatcaacctaataatgagaatatgtcgaataaagacgataatacaatccatttgaatgatagtcaaagtaatgaagacttagagctttttagacggaataaaaacgctcgccaacgcagaagacgtcgcatagataaccaaagtaaagaaaaagatgctacgtctacacaatcacagttagaaactaaaccaatggataaatttattgataatcacaagtcgcataatcaagataaagaaataaaaagtgatttaattgaggataatgttaatgatgaagatgacaatcaaaaatataataatgataaattaaatgatcgtagtgttcaacaaacaagcgaaacgcgtcaaagtaatgaagacgaagaggaatttctaactgatcatcagagcgaaaaacaaactaaagactctcgtcattctaaaaaacataaattactaagtaaatttacttctaaaaaagaaaaggaaacatttacatcgttcaatagtaatgagaaggtaactcaaattaaaccgcttagtttagaagaaaaaagagccataagacgtaaaaagcaaaaaagaatccaatatacaattatcacactactcattcttatcattgttctcattttactctatatgtttacaccactaagtaaaatatcaaatgtaaatattaaaggtaataacaacgtaagtacgagtaaaataaagaaagaacttaacgttacttcacgttcacgaatgtatacttttagtaaaaataaagcgattaggaacttaaaacagaatcctttaatcaaagaagttgatattcataaacaattaccaaacacgttaactgttaacgtgactgagtaccaaattgttggtttagaaaaaaataaagataaatatgtgccaattatagaagatggtaaagaattaacagaatacaaagatgaagtttcacatgatggacctatcattgatgggttcaaaggagacaaaaaaacacgaattataaaagctttatctgaaatgtcacctaaagtgagaaacttaatagcagaggtgagttacgcaccaactaaaaataaacaaagtcgcataaagatttttaccaaagataatatgcaagtcattggtgacattacaacgattgcagacaaaatgcaatattatcctcaaatgtcacaatcattaagcagagatgattctggcgaacttaagacaaatgggtatattgatttatcggttggagcgtcatttattccttatcaaggttcatcaactgttcaatcgggtactgaacaaaatgtaaccaagtcaacacaagaagaaaatgatgcaaaagaagaacttcaaaatgtgttgaataaaattaataaacaatctaaagaaaataat

SEQ ID NO: 530 - DNA, 1455 bp, Staphylococcus epidermidis
atgaagtgtttgttcaaaatgctatcaatcataataataatgttaagtactttcaccttattcatcagtccgagtacatatgcaaatgaagatgaaaattggactaaaataaaaaatcgaggagaactaagagttggattgtcagctgattatgcacctttagaatttgaaaagacgatacatggtaaaactgaatatgcgggtgtagatatagaattagctaaaaagattgcgaaagataatcatctaaagctaaaaattgtaaacatgcaatttgatagcttattaggtgcacttaagaccggtaaaatcgatattattatctccggtatgacaacaactcccgaacgaaaaaaagaagtggattttacaaaaccttacatgattacaaataatgtgatgatgattaaaaaagatgatgcaaaacgttatcaaaacatcaaagattttgaaggcaaaaaaattgctgcgcaaaaagggacagatcaagaaaaaattgcacaaactgagattgaagatagtaaaatttcttcactcaatagattacctgaagctatattatctttaaaaagtggaaaagtagcaggtgtagttgttgaaaaaccagtaggtgaggcatatttaaaacaaaattcagaactaacattttcaaagattaaatttaatgaagaaaagaaacaaacatgtatagctgttcctaagaactctcctgtacttttagataagctaaatcaaacgattgataatgtaaaagaaaaaaatttaattgatcaatacatgacaaaagcagccgaagatatgcaagatgatggaaattttatttctaaatatggcagttttttcattaaaggaattaaaaatactattttgatttcattagtaggtgtggtattggggtctattttaggctcttttatagctttattaaaaataagtaaaattagaccattacaatggatagcaagtatatacatagaatttttaagaggtactcctatgcttgtgcaagtgtttattgtattttttgggactactgcagctttggggttagatatttcagctttaatttgtggtactattgcgcttgttataaattcttcagcctacattgccgagattattagagctggtattaatgctgtagataaaggacaaactgaagctgctagaagtttaggattgaattatagacagactatgcaatcagtagttatgccacaggcaattaagaaaattttacctgcattaggtaatgaatttgtaaccttgattaaagaatcgtctatagtttccacaattggagtgagtgaaatcatgtttaatgcacaagttgtacaagggatatcttttgatcctttcacaccattgttagttgcagcattactatatttcttacttacatttgcacttacacgtgttatgaattttattgaagggagaatgagtgccagtgat

SEQ ID NO: 531 - DNA, 663 bp, Staphylococcus epidermidis
atgcaacaagaaacgacatcatggtacaaacaagaatggtttatagttttatcacttttattcatttttccactaggtttatttctcatgtggaaatttagcaagtggccatctattgcaagaacaatcattactgttgcaatttcagttatcgtattagcaagcattacctattatggtaatctacaaatgattgtaccagcaacatcaaattcaaataacgaaactaaagaaactacagagaataatgtaaatgataaagacgagcgaaatcataaaactgcagtagaagaaacaaaaactaattatgactccaccaaagaaaatactaaagaacctggaaaagaaaatgaatctgcaacacgattggagaactctgcgcttgaaaaggcaaagtcatattatgatgattttcacatgtctaaactaggaatttatgatattttaacatctgaatatggagaaaaatttgataaagaagatgcacaatatgctatagatcatctagaggctgattatgaaaagaatgcacttgagaaagcaaaatcatatgccaaagatatgcatatgtctaatgactcaatttacgatcttttggtgtctaactacggtgaaaaatttacagaatcagaagcaaaatatgctattgagcatttggataat

SEQ ID NO: 532 - DNA, 1593 bp, Staphylococcus epidermidis
atgagtcataagatattagtatcagacccaatttctgaggatggtttacaaagtattttaaaacatccagaatttgacgtagatatacaaacagatttatctgaaaatgatttagtaaatatgatttcaacttatgatgctcttatcgtacgaagtcaaacccaagtaacagagcgaattattaatgctgcaacaaatttgaaggtcattgcaagagctggtgtaggtgtggataatattaatatagaagcagcgactttaaaaggtattttagtaattaatgctcctgatggtaatacaatttctgctacagaacattcagtagctatgttgcttgcaatggcacgaaatattcctcaagcacaccaatctttacgtaacaaagaatggaatcgtaaagcatttagaggggttgaactttatggcaaaaccttaggtgttatcggtgctggtaggattggtttgggcgtcgctaaacgtgcgcagagtttcggtatgaaaattttagcgttcgatccttatttaacagaagataaagcgaagtcattagatattcaaattgcaactgttgatgaaattgccgaaaaatccgactttgtaacagttcacacaccattaacacctaaaactcgaggaattgttggttcatctttctttaacaaagctaaacaaaacttacaaatcataaatgttgccagagggggtattatagatgaaactgcacttattgaagcattagataataacttaatagatcgtgcagctattgacgtatttgaacatgaacctcctactgattcccctctcattcaacatgataaaattattgtcacaccacatcttggcgcctctactgtagaagcgcaagagaaggttgcagtctctgtatctgaagaaataattgaaattctaactaaagggaatgttgagcatgctgtgaatgctccaaaaatggatttaagcaaagttgataaaacaactcaaagctttataggtttaagtacaactattggtgagtttgctattcagcttctcgatggtgctccgagtgaaattaaagttaaatatgctggtgacttagcgcaaaatgacactagtttaattacaagaacaattataacgaacatcttgaaagaagatttaggtaatgaagtcaatattattaatgcattagcaatacttaaccaacaaggtgtcacgtataatatagaaaaacaaaagaaacattctggctttagtagttacattgagctagaactagttaatgatcaagataaaatcaaaattggcgcaacggtattcgcaggttttggcccaagaatagtacgtattaatgattactcacttgattttaaacctaaccaatatcaattagtaacatgtcataaagataaacctggtatagtaggacaaacaggcaacctattgggaagtcacggaattaatattgcgtcaatgactttaggacgtaacgatgctggtggagatgctttaatgattctttctattgatcaacaagcaagtgaggaagttataaaaattttaaatgaaacaagcggattcaacaaaattattagcactaagttaacaatt

SEQ ID NO: 533 - DNA, 1065 bp, Staphylococcus epidermidis
ttgaagcggaattttattaataatttaatcatattattaattgctattatgttaagtctgttattaaaaatgttacatgtgattttgccatttatgtttggaccaatattagcggcgttattatgtgtaaaagtattaaaattaaaaatacgatggccattttggttgagtcaaattggtttaatactacttggagttcaaattggctctaccttcacacaacaagtgattaaagacataagtaaaaattggctaactatcgtttttgtcactatcctactaattttattagctttgataattgcattcttttttaagaaaattgcacaagtaaatttagaaactgcaattttaagtgttataccaggtgcgctaagccaaatgttagtgatggcagaagaaaataagaaagcaaatatattagttgtgagtttaacacagacatcacgtgtaatatttgttgttattttagtaccacttatttcgtatttttttcaggataaccatcatgaaatgaatcatactacaatggaagtacccacactttctcagactttaaatatatggcaaataatcatcttattctcaatggtgggaatcatctatataggaatgtcaaaaattaacttccccactaaacaattattagcacctataatagttttaattatatggaatatgacaacacatttaacattttcactagatcattggttgttagccacagcgcaacttatttatatgatacgtattggattacagattgccaacttaatgagtgatttaaagggaagaattgcaatagcaatagcctttcaaaatataatgctcatagtcacaacgtttataatgataataggaatacatttgattactaatgaatccatcaatgaattgtttttaggagcagcaccaggaggtatgagtcaaatagttttagtggctatggctactggagctgatgtagcgatgatttcaagctatcacatttttagaatattttttatattatttgtcattgcgccactaattggttattttattaatgttaaattaaataataaa

SEQ ID NO: 534 - DNA, 2289 bp, Staphylococcus epidermidis
gtgaagaaaacgagtagaataattgcattcatactcctcatagctctactattcacaggaatgggtatgacgtataagaatgtagttaaaaatgttaatttaggtctagatttgcaaggtggttttgaagtcctcttccaagtagatcctttaaataaaggagataaaattgataaaaaagcacttcaagctacatctcaaacattagaaaatcgtgtaaatgttctaggtgtatcagaaccgaaaatacaaatcgaagatccaaatcgaattcgtgtacaattagcaggtatcaaggatcaagcacaagcgcgtaaattattatcgacacaagctaatttaacaattagagatgctgaagatcatgttttaatgtctggttcagacattaaacaaggctctgctaaacaagaatttaaacaagaaactaatcaaccaacagttacatttaaagtaaaaagtaaagataaatttaagaaagtaactgaaaagatttctaaaaaacgtgacaatgtcatggtagtttggttagatttcgaaaaaggcgatagttacaagaaagaagctaaaaagcaacaagaaggtaaaaagcctaaatttatatctgcagcgagtgtagaccaacctattaattctagtagtgttgaaatttcaggtggcttcaatgggaaaaaaggtgttgaagaagcgaaacaaatagctgagttattaaatgccggctcattaccagttgatttaaaagaaatttactctaactctgttggtgcacaatttggtcaagatgctcttgataagaccatgtttgcatcaattgtaggtatagcattaatttatttatttatgcttggtttctatcgtttgcctggtttagttgcaatcattgccttaaccacttatatttatttaactttagtcgcattcaatttcatatcaggtgtattaactctacctggattggcggcattagttttaggtgtaggtatggctgtcgatgccaatatcataatgtatgaacgtattaaagatgaactaagaattggacgcacgcttaaacaagcgtattcaaaagcaaataaaagttcattcttaactatatttgattccaacttaacaactgtcatcgctgcagctgtgcttttcttctttggagaaagttcagtcaaaggcttcgcaaccatgttactcttaggtattttaatgatatttgtaaccgcagtattcttatcaagagggttgttatcattactggtatcttcaaacttctttaaaaaacaatactggttatttggtgttaagaagaaggatagacatgatattaatgaaggtaaagatgtacatgatttaaaaacatcatatgaaaggttaaactttgttaaattagctaagccacttatttcacttagtattttaattgtaattattggtttgattatcatttcaatatttaaattaaacttaggtattgatttctcatccggaacaagagcagatattcaatctaaaaatgctataacacaagcacaggttgagaaaactgtaaaatcagttggattggaaccagatcaaatacagattaatggtagtggaaataaaaatgccacagttcagtttaaaaaagatttatcacgtgaggaagacaataaattaagtgctaaggtgaaatctgaatttggagataatccacaaattaataccgtttcacctctcataggccaagagctagctaaaaatgctgtaactgcattaatacttgcttctataggcattattatctatgtttcactaagatttgaatggcgtatgggtctatcttctgtacttgcattattacatgacgtatttatcatcattgcaatctttagtttgtttagattagaagtagatttaacatttattgcagcagtattaactatcgttggttattcaatcaatgatacaatcgtaactttcgaccgtgttcgagaaaatctgcataaagttaaagtaattacgcatactgatcaaattgatgatatagtcaaccgctctattagacaaactatgacacgttctattaatacagtgttgactgtagttgtagttgtagttgcaatattaatattaggtgcaccaacaatatttaatttctctttagcattactaattggattattatctggtgtattctcgtcaattttcattgctgtaccattatggggcatgcttaagaaacgacagtttaaaaagacaaaaaataataaattagtagtacacaaagagaagaaatctaacgatgaaaaaatcttagtt

SEQ ID NO: 535 - DNA, 1242 bp, Staphylococcus epidermidis
atgggggaaaatacaaaacaagatttcaatcaaaaaggacaaaattttaaattcacaaaaaaacatagacgattattatatggttcagtttttttaatggctacatcagctattggtccagcatttctgactcaaactgcagtgtttactgcacaattttatgctagttttgcatttgcaatattaatttctattattatagatataggcgctcaaataaatatttggagaatattagtggtaactggattacgtggacaagaaatatctaataaagtattacctggacttggtactattatctccatactaattgcatttggtggtctcgcatttaacataggtaatattgctggtgcaggtttaggtttaaatgcaatgtttggtcttgatgtaaaatggggtgctgcaataacagctatttttgcgatacttatctttgttagtagaagtggtcagaaaataatggatgttattagtatgattctaggtatcgtaatgattttagtagtcgcttatgtcatggttgtttcaaatcccccttatggagatgcattagtacatacatttgcacctgaacatcctttcaaacttatattacctataattacattagttggtggtacagtagggggttatattacttttgcaggtgcacatagaattctagattctggtataaaaggtaagtcataccttcctttcgtaaatcgatctgctgtagcaggtattttaacaactggtgtcatgcgcaccttattgtttttagctgtactaggtgttgttgtaactggcgttacgcttagttcagaaaatccaccagcatcagttttccaacatgcattaggtcctataggtaaaaatatttttggcgtagtaatatttgcagcagcaatgtcctcagtaattggttctgcatatacaagcgcaacatttttaaaaacactacacaaatcgttactcaataaaaataatcttatcgttattacatttattgtaatttcaacttttgttttcttatttattggtaaaccggtgagtttacttataatagctggtgcgattaatggttggattctaccaatcacattaggtgcaattctcattgcaagtaggaaaaaatctatcgttggtaattaccaacacccaacatggatgcttgtttttggtattatagccgtaattgtcacaataatgactggtatcttttcattacaagatttagcaagtctttggaaaggt

SEQ ID NO: 536 - DNA, 1380 bp, Staphylococcus epidermidis
gtgtctaataataattttaaagatgatttcgaaaagaatcgtcaatctattaatccagacgaacatcaaacagaattaaaagaagatgataaaacaaatgaaaataaaaaagaagctgactctcaaaacagtttatctaataactcaaatcaacaatttcctccgagaaatgcccaacgacgaaaaagacgcagagagacagcaactaatcaaagcaaacaacaagacgacaaacatcaaaaaaatagtgacgctaaaactacagaaggttcattagatgaccgttatgacgaagcacagttacagcaacaacatgataaatcgcaacaacaaaataaaactgaaaaacaatcacaagataatagaatgaaagatggaaaagatgcagctattgtaaatggaacatctgagtcaccagaacataaatcaaaatcaacacaaaatagacccggccctaaagctcaacaacaaaagcgtaaatcagaaagtacgcaatcaaaaccgtcaacaaacaaagataaaaaagcagctacaggtgctggaatagctggtgcagctggtgttgctggtgcagcagaaacatccaaacgtcatcataataaaaaagataaacaagattctaaacactcaaaccatgagaatgacgaaaaatctgttaaaaatgatgaccaaaagcaatctaaaaaaggcaaaaaagcagcagtcggtgctggcgcagctgcaggagttggtgcggctggtgttgcgcatcataataatcaaaataaacatcataatgaggaaaaaaattctaatcaaaacaatcagtacaatgaccaatcagaaggtaagaaaaaaggtggtttcatgaaaatcttgttaccacttatagcagccattcttattctaggtgcaatagcaatattcggtggtatggctctaaataatcacaacgatagtaaaagtgatgaccaaaaaatagcgaatcaaagtaagaaagactcagataaaaaagatggtgcgcaatccgaagataacaaagacaaaaaatctgatagtaacaaagacaaaaaatctgattctgataagaacgcagatgatgactctgataatagttcctcaaatcctaacgctacttcaactaataataacgataatgtagccaataataactcaaattatacaaaccaaaatcaacaagataatgcaaaccaaaatagcaataatcaacaggcaactcaaggtcaacaatcacatacagtatacggtcaagaaaacttatatcgtatcgccatacaatattatggagaaggaactcaagctaacgtagataaaattaaacgtgcgaatggattaagcagtaataatattcataatggtcaaacattagttattcctcaa

SEQ ID NO: 537 - DNA, 1554 bp, Staphylococcus epidermidis
atggctaaaggggaccaatatcaagctcatactgaaaaatatcatgataaaaagtctaaaaaaagttataaacctgtgtggattatcattagttttattattttaattacaatcttgttattacccacaccagcaggattacctgtaatggctaaagcagcactagctattttagctttcgctgtagttatgtgggttacagaagcagttacttatccagtttctgcaacattaattttaggattaatgatacttttactaggtttaagtccagttcaagatttatccgaaaaacttggaaaccctaaaagtggcgacataatactaaaaggtagcgatattttaggaacgaataacgcgcttagtcacgcttttagtggtttttcaacctcagccgtagcacttgtagctgcagcattatttttagcagtagctatgcaggaaaccaatttacataaacgacttgcattacttgtgctatcaattgttggaaataaaactagaaatatagtcattggtgctattttagtatctattgttctagcattctttgtaccatcagctacagcacgtgctggtgcagttgtcccaatattactgggaatgattgctgcatttaatgtgagtaaggatagtagacttgcttcattattaattattactgctgtacaagcagtttcgatatggaatataggtattaaaacggctgcagcacaaaatattgtagccatcaattttattaaccaaaatttaggacatgatgtatcatggggagagtggtttttatatgctgcgccgtggtcaatcattatgtctatagctctttattttataatgattaagtttatgccacctgaacatgatgcaattgaaggtggaaaagagttaattaaaaaggaacttaataaattaggaccagtcagtcatagagaatggcgactaattgtgatttcagtgcttttattattcttctggtcgactgagaaagtattgcatccgattgattcagcttcgattacactagttgctctaggtattatactaatgccaaagattggtgttattacttggaaaggtgttgaaaagaagattccttgggggacgattatagtatttggtgtaggaatctcacttggtaatgtattacttaaaacaggagccgctcaatggttaagtgatcaaacatttggtttgatgggtcttaaacatttaccgatcatagcaactattgcgttaattaccttatttaatatattaatacatttaggttttgcaagtgcaacgagcttagcctctgcgttaatacctgtgtttatttctttgacttcaacgctaaatttaggtgatcatgctattggttttgtattaatacaacaatttgtgattagttttggtttcctactacctgtcagtgcaccacaaaatatgcttgcatatggtactgggacttttaccgtaaaggattttttaaagacaggtatacctttaacgatagtaggttatattttagttatcgtatttagtttgacgtattggaaatggcttggtttagtg

SEQ ID NO: 538 - DNA, 834 bp, Staphylococcus epidermidis
atgttagatttcattaaccatttgcttagttatcaatttttaaatcgtgcattaatcacatctattttagttgggattgtatgtggaacgatgggtagcattattgttttacgtggtctttctttaatgggtgatgccatgagtcatgctgttttaccaggtgttgctttatctttcttatttaatattccaatgtttatcggggcacttgtaacgggaatgcttgcaagtttgtttattggttttattacttcaaacagtaaaacaaaaccagatgctgcaataggaataagtttcactgcattcctagcatctggcgtcataattattagtttaatcaatagtacaacagatttatatcacattttatttggcaatttattagcaattacacatcaatcattttggacaacaattgtcattactgtactggttattttacttattattatcttttatagacctttaatgatttcaacatttgatgcaacttttagtcgtatgagcgggctgaacacaacattaattcactactttgtcatgttattactcgcacttgtaactgttgcgagcatacaaacagttggaattatccttgtagttgctttactaatcactccagcttctacagcttttttaatcagtaaacaactttatgccatgatggtaattgcaagcataatcagcgtgataagttcgattatcggtctatattttagttatatatataatattccaagtggagcaactattgtaatctgtacctttatgatttatattgtaacgctatcaattactagaattaaaaataaacaaaaaaggagcgctttaacg

SEQ ID NO: 539 - DNA, 2679 bp, Staphylococcus epidermidis
ttggcaaagctattatacaaactaggaaaatttatagctaagaacaaatggctaagtgttataggatggcttgttatactaggtgttattatcacgccattaatgataaactcaccgaagtttgacagtgacatcactatgaacggccttaagtcattagacacaaacgataaaatcagtaaagaatttcatcaggacagtgagaaagcctcgatgaaaatagtcttccattctaataagaatgatggactcaataataaagatacgaagaaagatattgaagatgctttagacaatatcagacaaaatgatgattatatccaaaatatctctaatccatatgacagtggacaagttaatgatgaaggcgatactgctatcgctaacgtaagttatgtagttccacaaactggattaaaagattcttctaaacatatcatcgacaaagaattaaaagatgtaactgacaaccataatgtgcaaattgaaaaaactcaaggtggcgctatgaattccgaacctggtggtacatcagaaattgtcggtatcatcgtagcattcgtaatcttacttattacctttggttcacttatcgcagctggtatgccaattattagtgcaatcatcggtttaggttcaagtgttggtatcatcgcattattaacatatatctttgatattccaaacttcactcttacactagctgtaatgataggtttagctgttggtattgactactcactctttattctatttagatttaaagaacttaagaaaaaaggtgtcgatactgtagaagctattgcaacagcagtgggtacagcaggcagtgctgtaatattcgctggtcttacagttatgattgctgtttgtggtttatcacttgtaggaatcgacttcttagcggttatgggattcgcttcagcgattagtgtgttatttgcagtattagcagcattaacactattacctgccctaatcagtatcttccataaaagtattaaaattaaagataaaccaactaaaagtaaagaccctaaagatcattcttgggcaaaatttattgttggtaagccagttatcgctgttattgtaagtttaattattttaattttagctgctataccagtcagtggcatgcgtttaggtattccagatgatagtttaaaaccaactgactcatcagaatacaaagcctataaattaatctcagataattttggcgaaggttataacggacaaattgtcatgttagtaaatacaaaagatggtggaagtaaaagcactatcgaacgtgatttaaataatatgcgtagtgatttagaagacattgataatgttgatacagtttcaaaagcacaactaactgacaacaacaattacgcattattcacaatcattcctgaaaaaggaccgaactcacagtcaacagaaaatctagtatatgatttacgtgattatcatagccaagcgcaagaaaaatatgactatggcactgaaatttcaggacaaagtgttattaacatcgatatgtcagaaaaactaaacaacgctattccagtatttgcaggcgttattgttgtattagcattcttcttattaatgattgtgttccgttcgatcttagttccattaaaagcagtactaggctttatcctttcattaatggctacattaggtttcacaacattagtcattcaacatggctttatgggtagcttatttggtattgaaaacacaggaccattacttgcattccttccagtaatcacaattggattgttattcggacttgccatcgactacgagctcttcttaatgacacgtgtacatgaagaatacagtaagactggcgataatgatcattcaatccgtgtaggtatcaaagaaagtggacctgttatcgtagctgctgcacttattatgttcagtgtattcatcgcattcgtcttccaagatgacagtgcaattaagtcaatgggtatcgcattaggtttcggtgtgttattcgacgcattcgtcgtacgtatgacattaattccagcattgacgaaactctttggtaaagcttcatggtaccttcctaaatggttaggtgcagtattgccaaacgttgacgttgaaggtaaagctttagaagaagataatcatcacgacacatcttctgaaaaaggtcatgtcaacgataaaaatagtgaatactctagacaagacaaagataactatgtttatcaaaatgacaaacgtaactacaatcgcaattataatgacgaagattataaccgttctgtgcatttaaataatcatcatgaccagcatcatcgccaacatcaatatgataatcaacgtgatgatatcgactatgaatcactttatactcaagatggcgaccatactcatcatgatgaacgtaattataatgatcgacactatcaagacaattacgatagaaatgatgattatcgtcacaacaatcatgatcatcaaaatgataaccatgattatcatgattcaaattttgataaaacaacaaacttatacaaagaattaactgatagcaatattgatcaagatgtattattcaaagcattaatgttatacgctcgtgaaaacaacaaaggtgtttacgatagatataaccgatcatctcaacatcgtcatgatgacgaacttagagac

SEQ ID NO: 540 - DNA, 399 bp, Staphylococcus epidermidis
atgaataaaaaagtagaacatatcggtaaccaatatacgtcacaagaaaataagaaaaaacaacgacaaaaaatgaaaatgcgtgttgtacgtagacgtattgctttattcggaggtattcttttagcgattatcctcattctacttgtattgcttgtcattcaaagacataataacgatcaagatgcagttgaaaggaaagagaaagaaactgagtttcaaaaacaacaagatgaagaaattgctttaaaagagaaacttaataatttaaatgataaagactatatcgagaaaatagcgagagacgattattatttaagtaataaaggtgaagtcatttttagattacctgatgataaaaaatcctctcagtcaaagacttcaaacgaaaaaggcaat

SEQ ID NO: 541 - DNA, 375 bp, Staphylococcus epidermidis
atgaagatacgtttaacatttattatcttagcaatactatccaccatcggcttagtacttgttttagcaaaatatccaacaggcccacacacaatcaactataacgaaccttatacagtactcatagccattacgacaatagttataatggctttaccagcactcatattaggtatatttaatcatcttgcatgtagaatcatatcggcgatattacaaataagtgcactgatgatgtgggggtttttagtaatcattagcttaattatgggacaaattgtcattatgcttatggcttccttaacgatacttgcattacttgttagttctattgtcacactttcagtgcacccatctacttcagataaaataaat

SEQ ID NO: 542 - DNA, 1116 bp, Staphylococcus epidermidis
atgaataagaaactattgtggagcatcattggtattgtaattattgtcgtattaatcattgctgcttttatattaaaacaagttaatggttcaggtagtaaagatagtaatgcttacgatacatatacagtaagaaaagaaacacctattagtttagaaggcaaagcgtctccagaatctgtgaaaacttataacaataatcaatctgtgggtaacttcttaagtgtttcagtacaagatggtcaaacagttaaacaaggtgaacgtatcatcaattatgatacaaatgggaataaacgccaacaactattgaacaaagtgaatcaagcacaatctcaagttaatgatgattatcaaaaagtaaatcaaagtcctaacaatcatcaattacaagttaaattgactcaagatcaaagtgctttaaatgaagctcagcagtcattgtcacaatatgacagacaactcaatgacagcatgaatgcatcatttgatggtaaaattaacattaaaaatgattcagatgtaggcgaagggcaacctattttgcaattaatttcttcaaatcctcaaattaacgcaactattacagagtttgatattaataaaattaaagaaggcgatgaagtaaatgtcactgtaaatagcacaggtaaaaaaggaaaaggaaaaattcttaaaatagatgaacttcctacaagctatgatacaagtgacgatagtacagcatcatcggcacaagcaggggcacaaggtgatagtgaagaaggaactgaaatgacgacatctaatcctacaattaatcagccaacaggtggtaaaagtggcgaaacatcaaaatataaagttatcattggtgatttagatatacccgtgagatcaggcttctctatggatgctaaaatccctcttaaaactaaaaagctaccaaataacgtgttaacaaaagataataacgtatttgtcgttgataaaaataataaagttcacaaacgtgaaattaaaattgaacgtaataatggtgaaatcattgtgaaaaaaggattgaaatctggcgataaagtccttaaaagtccaaaaggtaatttaaatgatggagaaaaagtagaggtgtcatca

SEQ ID NO: 543 - DNA, 2019 bp, Staphylococcus epidermidis
atggctgaaactactaaaatatttgaatcacatttggtcaaacaggctctaaaagacagtgtattgaagctctatcctgtttatatgattaaaaatccgattatgtttgttgtagaagtgggcatgctgcttgccttaggattaaccatttatccggatttatttcaccaagaaagtgtatcacggctatatgtgttcagtatctttatcatattattactgacacttgtctttgcgaacttctctgaagcattagctgaaggtcgcggtaaagcacaagccaacgctttacgccaaacacaaactgaaatgaaggcacgtcgtattaaacaagacggcagttatgaaatgattgacgctagtgacctgaaaaaaggacatatcgtacgtgtcgcgacaggtgaacaaatcccaaatgacggtaaagttattaagggcctcgcaacagtggatgaatctgcgattacaggtgaatctgcacctgtaatcaaagaaagcggtggagatttcgataatgtaattggaggaacttctgtagcttcagactggttagaagttgagattacttcagaaccaggtcattcatttttagataaaatgattggtttggttgaaggggctacaagaaagaaaacacctaatgaaattgcgttatttactttattgatgacattaacgattatcttcttggtcgttattttaacgatgtatccattggcgaaattcctgaatttcaatttatccattgcgatgctgattgctttggctgtgtgtttaattccaacaaccattgggggattattatcggctatagggattgcagggatggatcgtgtgacacagtttaatatcttggctaaaagcggacgttctgtagagacttgtggtgatgtgaatgtcttgattttagataaaacaggtaccattacctacggcaaccgtatggcagatgcgtttattccggtgaaatcatcaagctttgaacgtttagttaaagcggcctatgaaagttctatcgcagatgacacaccagagggacgtagtattgtgaaattagcttataaacaacatatcgacttaccgcaagaggtcggagaatatattccgtttactgctgaaacacgtatgagcggtgtgaaatttacgacacgtgaagtatataaaggtgcaccgaatagtatggttaagcgtgtgaaagaagcagggggacatattccagttgatttagacgctcttgtcaaaggggtgtctaaaaaaggtggcacaccgctggttgtgcttgaagataatgagattttaggtgttatttatttgaaagatgtcattaaagatggactcgtagaacgtttccgtgaattacgtgagatggggattgaaacggtgatgtgtacaggagataacgaattgacagctgcgacaatagcgaaagaagcgggtgtggatcgctttgtggcagagtgtaaacctgaagataaaatcaatgtgattagagaagaacaagcgaaaggtcatattgttgcgatgacgggtgacggtacgaatgacgcgccagctttagcagaagctaatgtaggtttggcaatgaactcaggaaccatgagtgccaaagaagcggcgaatttaattgatttagattctaatccaaccaaactgatggaagtcgttctaattgggaaacaattattaatgacacgtggctcactcactacatttagtattgcgaatgacattgcgaaatactttgcgattttaccagccatgtttatggcggctatgcctgcgatgaatcatttgaatattatgcatctgcattcacctgaatcagcagtattatctgcgttaatctttaatgcgttgattattgtattattgattccgattgcgatgaaaggcgtgaaatttaaaggtgcctcaacgcaaaccatattgatgaaaaatatgttagtttacggcttaggcggtatgatcgtgccatttatcggcattaagctcattgatctcatcatccaactctttgtc

SEQ ID NO: 544 - DNA, 876 bp, Staphylococcus epidermidis
atgattgtgttacgtcgtctatttcaagatagaggtgccatatttgctatagctattattacaatctacgtagtgcttggagttttagctcctttaattacattctatgaaccgaatcacattgatacagcaaataaatttgctggtataagttggtctcactggttgggaacagaccatttaggtcgagatgtattaacacggataatatacgccataagacctagtttgttatatgtatttgtcgcattgattatttccgttgtgataggagcgatacttgggtttatttcaggttatttcccaggttatatcgatgcaataattatgcgtatatgcgatgtgatgttagcttttccaagctatgtggtcacattggcattgattacgttgtttggcatgggtgtagaaaatattattattgcatttatattgactcgatgggcgtggttttgtcgcgtgattcgaaccagtgtaatgcaatatattgaagctgatcatgtaaaatttgccaaagtaattggtatgaatgatttaacaatcattcgcaaacatattttgccactaacctttactgacatagcgattattgctagtagttcgatgtgttcaatgatattacaaatgtcaggattctcattccttggattaggtgttaaggcacctacagccgaatgggggatgatgcttaatgaagcacgaaaagtaatgttcacacatcctggaatgatgatgacaacaggtgtggctatcgtcataattgtgatggcgtttaactttttatcagatgctttacaaatggcgattgatcctcgtatgtccgctaaagaaaaacgactggctctgaagaaaggtgtgaaagcacgtgacactgct

SEQ ID NO: 545 - DNA, 1188 bp, Staphylococcus epidermidis
atgaaaggtgccatgtcttggccttttttaagattatatattttaacattgatgttttttagtgcgaatgccatactcaatgttttcatacctctaagaggacatgacttgggggcgacgaatactgtaattggaattgtaatgggagcttatatgctaacggcaatgctatgtcgcccctgggctggtcaaattattgcacgtattggtccgattaaagtattgcgtattatattattgattaatgctatggcactggtattatatgggtttacaggacttgaaggttatttgattgcacgtatcatgcaaggtgtgtgtacggcattcttctcaatgtctttacaattgggtattatagatgctttacctgagaaatatcgttcagaaggtgtatctctctattcattattttcaacgattcccaatttattaggaccattaattgcagttgggatttggcacgtggaaaatatgtccatatttgctattgttatgatttttattgcagtaacaacaaccttatttggttatagaactacttttgcaaatacacaaaaagaggtatcaccaaaagacgaagtcttgccttttaatgcaatgactgtatatgtccaattttttaaaaataaagcactcttctgcagtggtatgattatgatcttgtcatctatcgtgtttggtgcgatgagtacttttataccattatatacggttagggaaggtttcgcgaatgcaggtattttcctcacaattcaagccattacagtagtgatagctagattttatttacgtaagtatgtaccatctgatggtttatggcatcaccgttttatgatgattgtcttaacgttactgatggttgcttcagtcattgtagcttttggaccacatatagtgagtatatttgtatatataagtgcaatctttatcggaataacacaagcgctcgtttatcctacattgacaacgtatttaagttttgtcttaccaaagataggacgtaatatgttattaggattgtttatagcatgtgcagatttagggatttcactaggaggtgtgctaatggggccaatatcagatacggtaggatttaaatggatgtatattttatgcgctttattggttactattgcaatgacactaagtaaaattagacaaagacaaagtgtttcaaaagcctca

SEQ ID NO: 546 - DNA, 1416 bp, Staphylococcus epidermidis
gtgggaagtactgttaaatatcgtaagtttattctacctattgtcgttggtttaattatctgggcattgacgcctattaaaccagatgccttaaatgatcaagcttggtttatgtttgctatttttgtgtcaaccatcattgcttgtattacccaacctatgactataggtgcagtatcaatcattggttttacaatcatgattttggttggaattgttgatacaaaaactgccgttcaaggcttcggtaatagtagtatttggcttattgcaatggcctttttcatttcaagaggatttgtaaaaacagggctaggtcgacgtattgctctgcaattcgttaaattatttggaaagaaaacgcttggtttggcttattcacttgttggtgttgatcttatcttagctcctgctacgccaagtaatacagcacgtgctggtggtattatgtttccaatcattaagtccttgtcagagtcatttggttcatcgccgagagatggttctgagagaaaaatgggtgcgtttttaatctttactgagttccaaggtaatttaattacttcagctatgtttttaacagctatggccggtaaccctatagcgcaaagtttagctgaaaaaacggcacacgttcaaattacatggatgaattggtttgttgctgctattatacccggattgatttctctcatcgttgtccctttcattatttataaattatacccaccaactgttaaagaaacgcctaacgctaaaaaatgggctactgaacaactagaagaaatgggacatatgtctatagccgaaaaattgatggttggtatctttatcatagcattggctttgtgggtattaggaagcttcattaatgttgatgccacgctcactgcatttattgctttagcattgttactattaacaggtgtattagcgtggtcagatattttaaatgaaacaggcgcatggaatacactcgtttggttctcagttcttgtattaatggcagaacaattaaacaagttaggctttatcccatggttaagcaaactcattgctcaaggtttaaatggctttagttggcctatcgttttagttttactcatcttgttttatttctactcacattatttattcgcaagtgcaacagcacatgtcagcgccatgtacgccgcgttactcggtgttgcagtcgcttcgggtgcaccgccattattcagtgcattaatgttagggttctttggtaacttactggcatcaacaacacactatagtagtggaccagcgcccatattatacgcagctggctatgttacacaaaagcgctggtggactatgaatattgtacttggtatagtctattttattatttggattggtgtaggttcactatggatgaaactcataggtatgatg

SEQ ID NO: 547 - DNA, 1173 bp, Staphylococcus epidermidis
atgaaagataataaaatgttgttcattatttttatgataggaacatttacagtaggaatggctgaatatgtagtgacaggattacttacacaaatcgctgacgatatgaaggtttctatttcgagtgcaggtttattaattagtgtttatgctattagtgttgcattgatagggcctttaatgcgaatcataacattgaaagttcacgcccaccgtctgttaccgattttagtagcgatttttataataagtaatttagtgggaatgttagcaccgaattttaatgtattgttattatcaagactcatgtctgcggcaatgcatgcgccattcttcggtgtgtgtatgagtgttgctgcgacagtcgcacctcctgctaaaaaaacacaggccattgcacttgttcaggcaggtttaactattgctgtaatgttaggtgtaccattcggatcatttttaggtggctttgcaaattggagagttgtttttggatttatgattgtgttggcaatcattactatgttaggaatgattaaatttgttccaaatgtttctttaagtgcagaagcaaatattagcaaagaattaacagtgtttaagaatccacacattttaattgtgattgcaattattgtgtttggttactctggtgtgtttactacttatacatttatggagccaatgatacgagatttttctccatttaaaattgtaggtttaactgtttgtttatttatgtttggtctaggcggtgtgatagggaatttaattactggtaatgtaccggaagataaattaacaaaaaatttataccttacatttcttttactatttgtaacaatcatactatttgttactgttattcaaaattcaatattagcattaatcatttgcttcttattcggttttggtacatttggtacaaccccgttacttaatagcaaaattatcttaagtggaaaagaagcaccacttcttgcaagtacgttagcagcttctattttcaatgttgctaattttcttggtgcaataattggatctatattattatcaatagggttaccttacattcaaattactttgatatctggtggaattatagtgttgggtatgcttcttaatcttgttaatcaactttatgaaaagaaacatatcacatttaatgaatattca

SEQ ID NO: 548 - protein, 55 aa, Staphylococcus epidermidis
QVLKMLQNILLLMLLLLMLKIKVLIYLIMTLLNQFRDMVLKLRFINNKSLWAIEN

SEQ ID NO: 549 - protein, 52 aa, Staphylococcus epidermidis
KRLVMQQHLQFNLPKIILLNALTKRFLSLLVTQLVMVFILVVSLLKVPVQLQ

SEQ ID NO: 550 - protein, 32 aa, Staphylococcus epidermidis
LRLRQFQLLCTLVLLMLVALFLHAFLRYLMTK

SEQ ID NO: 551 - protein, 29 aa, Staphylococcus epidermidis
RLRYTSYIIKLAATDAFKLLTCPTIGILI

SEQ ID NO: 552 - protein, 70 aa, Staphylococcus epidermidis
SSVFAIRLTITFSRFSNVGCKKHIKGAIIMKKEIIEWIVAIIVAIVIVTLVQKFLFASYTVKGASNVIYH

SEQ ID NO: 553 - protein, 31 aa, Staphylococcus epidermidis
RSVPHIVVLTMRIIASVLLVIVGFSLSVSCA

SEQ ID NO: 554 - protein, 97 aa, Staphylococcus epidermidis
TANNIISFIITLTNIYKTKLMGYFFNIIELRNKFIRRCWAILFIAIIHFISECFLPHIPTNCYVSRFDFLDSAKNMSYKTLNTICRNSFRIVHKLIV

SEQ ID NO: 555 - protein, 37 aa, Staphylococcus epidermidis
FFCRLTQLNWLKYLSVRMLYMYFMIFSIMNHIVSTIC

SEQ ID NO: 556 - protein, 31 aa, Staphylococcus epidermidis
IFISTCGCSTTSAWKAEVLPLRVRFPSPAPF

SEQ ID NO: 557 - protein, 44 aa, Staphylococcus epidermidis
LKNILRIVFIAGLTVFFSGPGQTYSNAAFIDEYIQTFGWSRTEV

SEQ ID NO: 558 - protein, 51 aa, Staphylococcus epidermidis
RNSNQMYQTFTADIVLIFMIIVLGGLVVQVPMPILAGIMVMVSETIYCLHL

SEQ ID NO: 559 - protein, 17 aa, Staphylococcus epidermidis
NQRLEETISSPHHSSAL

SEQ ID NO: 560 - protein, 433 aa, Staphylococcus epidermidis
MKQFLNITQRKFIEWLIILSIFIVSIPNKWTLMISIALSLLLLKRGALGVVQLIILYMLRSQIYTPYDTQEMAHYIVSMKYILIYVIGVFFLFKYVKHWIRNEMILRFIKSTMILMLLYIIMSLVVSNDPIESILKLLNFFIPLILIVMYVSLIKKIKNLINWINQFITLVIAFTFLFIVIAPKSYLIDEESLRSVFKDAHSFAVILAMGLVLYMVTIIKQQDYDVFNLLLLNIGMIELYLSNSRHIFISVILCLMLLLPLSHIKKRIKHPIIGAMILMAIAIINQPYIYHLFIKLILKGKNSQEVFMPSDMNIKAIDYALTEHPFLGSGFGIPMIKASSEIQYFNVATSNIIFGMIIFTGIIGLTLCTIYMLHMVLLVTFPMSITILLFLITIFVNMDYIILFDSVGLGILCYIFWGIYLKEGMYQYNNGQW

SEQ ID NO: 561 - protein, 369 aa, Staphylococcus epidermidis
MTNQKTVGLVVAPGVTERLAENLIQEMPKMLSTHYDHQQEWIFDLVTDPLTGFAESVDEIFGKVADYHDKRQWDYVIAITDLPMFADKQVMALDINMENGAAIFSYPAFGWRPVKKRFKHAIYNIIQELNEAEQESRNYDNNKQIENSVKKQFPLSKIDKETIYMKETDSYHLRYLSSSRSRGMFRLVSGMTFANNPLNMMASLSNIVAIAFTTGAFGLVFTTMWQMAYNFSMWRLFGISIIAIIGMLIWIMMSHDLWEPVNKSNHKHITWLYNLTTIMTLIFAIIIYYIILYLLFLIAEIVLLPSGFLGQQVGLKGPAGIDLYLSIPWFAASISTVAGAIGAGLLNDELIKESTYGYRQRVRYEEQRR

SEQ ID NO: 562 - protein, 249 aa, Staphylococcus epidermidis
MKFCPHCGNPIKKEQSFCNKCGKHLKTSTQRKSENQIEHMREQQSYISREERQHHDSTFYKEQKHTGWLIVLSIIFVLLIAALLYGAYYAYNHYISDEQSHQTTESQQSNESDQNRDQSTGPSIDVFSDDFDQGYMKSASTSGYRGVYNGMTREEVEDKFGTSNGSVESLKWSYETYGDLAVAYDDNEVVSVGVAPNHISEDQFLSMYNEPDDRNSSQLIYDSNKDNDFSVLANVKNGDVTVIENVNQI

SEQ ID NO: 563 - protein, 432 aa, Staphylococcus epidermidis
MLLFIIEIIIMILAILLGLRTAGALGCGIFAIVAQLIMIFGFQLPPGSAPVTAVLIILSIGIAGGTLQATGGIDYLVYIASRVIERFPKSIIFIAPMIVFVFVFGIGTANIALSLEPIIAKTAQKARIQPKRALTASVLTANLALLCSPAASATAYIISVLAGYEISMGKYLSIVLPTALISMLMLSTFCTFVGRKEHVRDESERLVQMPEVEIKNDFSLKVKIGVISFLLCVMGILTFGIFPNLMPQFNVNGDVVKVEMTEIVQFFMYLSATINLLLIKINTSDILSSNITQSAMGALFAVLGPGWLGATIFNAPHNLKILKNDIGSIISEVPWLVIILVSVVAMIVISQTATASIMVPIVMSLGIPPIYFVAMVQTLNVNFVIPAQPTLLFAVELDETGRTRPTSFMIPGFFVITVSVITGFVIKTILGY

SEQ ID NO: 564 - protein, 483 aa, Staphylococcus epidermidis
MGSFFNRMTRKENPTIYQNKDGHLKRTLRVRDFLALGVGTIVSTSIFTLPGVVAAEHAGPAVALSFLLAAIVAGLVAFTYAEMASTMPFAGSAYSWINVLFGELFGWVAGWALLAEYFIAVAFVASGFSANLRGLIAPLGISLPKSLSNPFGSNGGVIDIIAAVVIILTALLLSRGMNEAARMENVLVILKVLAIILFVIVGLTAINFSNYIPFIPEHKVTETGDFGGWQGIYAGVSMIFLAYIGFDSIAANSAEAINPQKTMPRGILGSLIVAIVLFVAVALVLVGMFHYSQYADNAEPVGWALRESGHGIIAAIVQAISVIGMFTALIGMMLAGSRLLYSFGRDGLLPSWLSQLNHKHLPNRALVILTIIGVVIGSMFPFAFLAQLISAGTLVAFMFVSLAMYRLRKREGKDLPKPEFKLPLYPILPAITFILVLLVFWGLSFEAKLYTLIWFIVGIIIYLIYGIRHSKKNDEEAYQVPRE

SEQ ID NO: 565 - protein, 357 aa, Staphylococcus epidermidis
MTKKKRLSPSEWLLKQSKRHKRKNTLYTAIVLLVALVLLIFAVKSIQVEPVKSDTRDKDSIRITYLGNVTLNKHIRQTNLNDVFKGIQDTLDHSDFSTGSLIVNDFSRNQKDNINKNIENIMFLRKHNVKSVNLINESMDNIQATAMMRKIDSQAGYNFLTGNGSNPINSKTVQQDIKGKKIANVSFTDIESNYTNSLKNTTSISLDPAIFYPLIKKLKENNDYVVVNVDWGIPNERNVTTRQKEYAHALANAGADVIIGHNTVIQKVENYKRTPIFYSLGNTTSDNFLSKNQKGMIVQQDWKGSHNQFHITPIQSKDGKISKDNMNKMDHIRFKNNIKDKSIDLKSDQNGGYTFEY

SEQ ID NO: 566 - protein, 233 aa, Staphylococcus epidermidis
MIEHLGINTPYFGILVSLIPFVIATYFYKKTNGFFLLAPLFVSMVAGIAFLKLTGISYENYKIGGDIINFFLEPATICFAIPLYRKREVLKKYWLQIFGGIAVGTIIALLLIYLVAITFQFGNQIIASMLPQAATTAIALPVSDGIGGVKELTSLAVILNAVVISALGAKIVKLFKISNPIARGLALGTSGHTLGVAAAKELGETEESMGSIAVVIVGVIVVAVVPILAPILL

SEQ ID NO: 567 - protein, 233 aa, Staphylococcus epidermidis
MKRTDKYRDSYKYDDQYQNHRKRSEEDMYRQHQESQQRANSNRATQSENDREYENHPERYYNGRDYRREQQLEEENEKSSKTKKWLIAIIVILLIIVAIFITRAIINHNNDKVSNDPNVSQNYKKEVENQNDDINRQVDSAKSDIKNKKDTQSQIDKLQNQIDQLKQNEETNADSKFTKFYQNQIDKLKNANNAQLNNENQSKVNNMLEDINTKFDSIKAKLENILNGSNSGN

SEQ ID NO: 568 - protein, 116 aa, Staphylococcus epidermidis
MKNKKGLGIGLITIMIIVCIVLVIMMFVGGKKESYYGIMKDSTTIDKMINTKNEKIEKNVELPKDANVSVKKEDFVMLFKDEKTGKITKVKKVNHDDVPHGLMSKIHDMGNMKHGM

SEQ ID NO: 569 - protein, 214 aa, Staphylococcus epidermidis
MAMSLLVSLVVYMMTLTSDILEDILSFKLEVIMQFPYILSSISLIILFILFILKDMEKIWYWLISIVMIAVISMSGHVWSQQVPLWSIIIRTIHLIGLTLWLGSLVYLICYAIKVKINQLTSVRRMLLKVNIIAVIMLVFTGILMAIDETNTLTLWNNVSAWSIYLVIKIAGIIAMMLLGFYQTMRALRQRQQVHRFALMTELLIGMILILQVS

SEQ ID NO: 570 - protein, 382 aa, Staphylococcus epidermidis
MKNSRFSGFQWAMMVFVFFVITMALSVILRDFQATIGVKRFVFSIKDLAPFIAAIVCILVFKHRKEQLAGLKFSISLKVIERLLLALILPLIILMIGLFSFNTYADSFILLQTSDLSVSLLTILIGHILMAFVVEFGFRSYLQNILETRMNTFFASIVVGLIYSVFTANTTYGVEYAGYHFLYTFMFSMIIGELIRATNGRTIYIATAFHASMTFALVFLFSEETGDLFSMKVIALSTTIVGVSFIIISLIIRAIVYKTTKQSLDEVDPNNYLSHIQDEEPSQEDASSTSNHDVSSKDETKQQDIDNDKHQSKKPNKSDDALTTSNYKEDASSVNKETDTTHNDNIKDHSTYTEDRHSSVVNDVKDEIHEVEDHKADTDKSH

SEQ ID NO: 571 - protein, 458 aa, Staphylococcus epidermidis
MENNELQRGLNARQMQMIALGGTIGVGLFMGATSTIKWTGPSVILAYLIAGIFLFLIMRAMGEMIYINPTTGSFATFASDYIHPAAGYMTAWSNVFQWVVVGMSEVIAVGEYMNYWFPSLPNWIPGVIAVLFLMAANLVSVKAFGEFEFWFALIKVVTIVLMIIAGLGLILFGIGNGGNPIGISNLWSHGGFMPNGFIGFFFALSIVIGSYQGVELIGISAGETKNPQTNIVKAVNGVIWRILIFYIGAIFVIVSVYPWNQLGSIGSPFVATFAKVGITFAAGLINFVVLTAALSGCNSGIFSASRMIYTLAKKGQMPKVFTKVMKNGVPFYTVFAVSMGILIGALLNVILPLIIDGADSIFVYVYSASILPGMIPWFMILFSHLRFRRLHPEKVHNHPFKMPGGAIANYLTIMFLLLVLVGMLLNKETVVSVVIGIVFLTAVTLYYLIRYHKKERQI

SEQ ID NO: 572 - protein, 485 aa, Staphylococcus epidermidis
LQDFDNLIPGWFKTFVQVGNDLIWSQYLIGLLLTAGFFFTISSKFIQLRMLPEMFRALTEKPETLSSGEKGISPFQAFAISAGSRVGTGNIAGVATAIVLGGPGAVFWMWIIAFIGAASAFMEATLAQVYKVHDKEGGFRGGPAYYITKGLNQKWLGIVFAVLITVTFAFVFNTVQANTIAESLNTQYNISPVITGIVLAVITGIIIFGGVRSIATLSSLIVPIMAIVYIGMVLIILLLNIDQIVPMIGTIIKSAFGVQQVTGGAVGAAILQGIKRGLFSNEAGMGSAPNAAATSAVPHPVKQGLIQSLGVFFDTMLVCTATAIMILLYSGLQFGDSAPQGVAVTQSALNEHLGSAGGIFLTVAVTLFAFSSVVGNYYYGQSNIEFLSNNKMILFIFRCFVVLLVFVGAVAKTETVWSTADLFMGLMAIVNIISIIGLSNIAFAVMKDYQRQRKEGKRPVFKPENLEINLFGIETWGQHAKMPKK

SEQ ID NO: 573 - protein, 191 aa, Staphylococcus epidermidis
LKKEILEWIVAIAVAIALIAIITKFVGKSYSIKGDSMDPTLKDGERVVVNIIGYKLGGVEKGNVIVFHANKKDDYVKRVIGTPGDSVEYKNDTLYVNGKKQSEPYLNYNEKRKQTEYITGSFKTKNLPNANPQSNVIPKGKYLVLGDNREVSKDSRSFGLIDKDQIVGKVSLRYWPFSEFKSNFNPNNTKN

SEQ ID NO: 574 - protein, 361 aa, Staphylococcus epidermidis
MFNKVWFRTGIFFIMLFILIKLFMEVHEVFAPIATIIGSVFLPFLISGFLFYICLPFQNILEKWGFPRWASITTIFIGLIAIIAIVVSFIAPIIISNINNLIKQTPSLQKEAEQLINFSLRQMDKLPDDVTHRINKAVKSMGDGATSILSNSVSYITSFISTVFLLIMVPFFLIYMLKDHEKFIPAIGKFFKGERKVFVVDLLKDLNFTLKSYIQGQVTVSIILGIILYIGYTIIGLPYTPLLVLFAGVANLIPFLGPWLSFAPAAILGIIDGPSTFIWVCVVTLIAQQLEGNVITPNVMGKSLSIHPLTIIVVILAAGDLGGFTLILVAVPLYAVIKTLVSNIFKYRQRIVDKANSNVKD

SEQ ID NO: 575 - protein, 96 aa, Staphylococcus epidermidis
MNTIVKHTVGFIASIVLTLLAVFVTLYTNMTFHAKVTIIFGFAFIQAALQLLMFMHLTEGKDGRLQSFKVIFAIIITLVTVIGTYWVMQGGHSSHL

SEQ ID NO: 576 - protein, 383 aa, Staphylococcus epidermidis
MLGEQYTQIKRPANRLTEKILGWFSWVFLLILTIVSMFIALVSFSNDTSIANLENTLNNNELVQQILANNDLSTTQFVIWLQNGVWAIIVYFIVCLLISFLALISMNIRILSGLLFLIAAIVTIPLVLLIVTLIIPILFFIIAMMMFARRDRIETVPSYYNEYDQPYYDERGFYEPESRNEHGYNDDVYEPMHTKKEDRNTRRQFNRNAQQQDSYNGITDNQPDEDTSSDQLYSDEYVDNEDKYSQFPKRAVESEYASQQTEDEPTVMSRQAKYNKKSKNTDFEDAQQEHMEGNQFDDVGVVEPQIDPKELKAQRKREKAEIRAKKKEKRKAYNKRMKERRKNQPSAVNQRRMNYEERRQMINNEQEDTDNNLNQQEDSKKEN

SEQ ID NO: 577 - protein, 463 aa, Staphylococcus epidermidis
MEENKNQPNNENMSNKDDNTIHLNDSQSNEDLELFRRNKNARQRRRRRIDNQSKEKDATSTQSQLETKPMDKFIDNHKSHNQDKEIKSDLIEDNVNDEDDNQKYNNDKLNDRSVQQTSETRQSNEDEEEFLTDHQSEKQTKDSRHSKKHKLLSKFTSKKEKETFTSFNSNEKVTQIKPLSLEEKRAIRRKKQKRIQYTIITLLILIIVLILLYMFTPLSKISNVNIKGNNNVSTSKIKKELNVTSRSRMYTFSKNKAIRNLKQNPLIKEVDIHKQLPNTLTVNVTEYQIVGLEKNKDKYVPIIEDGKELTEYKDEVSHDGPIIDGFKGDKKTRIIKALSEMSPKVRNLIAEVSYAPTKNKQSRIKIFTKDNMQVIGDITTIADKMQYYPQMSQSLSRDDSGELKTNGYIDLSVGASFIPYQGSSTVQSGTEQNVTKSTQEENDAKEELQNVLNKINKQSKENN

SEQ ID NO: 578 - protein, 485 aa, Staphylococcus epidermidis
MKCLFKMLSIIIIMLSTFTLFISPSTYANEDENWTKIKNRGELRVGLSADYAPLEFEKTIHGKTEYAGVDIELAKKIAKDNHLKLKIVNMQFDSLLGALKTGKIDIIISGMTTTPERKKEVDFTKPYMITNNVMMIKKDDAKRYQNIKDFEGKKIAAQKGTDQEKIAQTEIEDSKISSLNRLPEAILSLKSGKVAGVVVEKPVGEAYLKQNSELTFSKIKFNEEKKQTCIAVPKNSPVLLDKLNQTIDNVKEKNLIDQYMTKAAEDMQDDGNFISKYGSFFIKGIKNTILISLVGVVLGSILGSFIALLKISKIRPLQWIASIYIEFLRGTPMLVQVFIVFFGTTAALGLDISALICGTIALVINSSAYIAEIIRAGINAVDKGQTEAARSLGLNYRQTMQSVVMPQAIKKILPALGNEFVTLIKESSIVSTIGVSEIMFNAQVVQGISFDPFTPLLVAALLYFLLTFALTRVMNFIEGRMSASD

SEQ ID NO: 579 - protein, 531 aa, Staphylococcus epidermidis
MSHKILVSDPISEDGLQSILKHPEFDVDIQTDLSENDLVNMISTYDALIVRSQTQVTERIINAATNLKVIARAGVGVDNINIEAATLKGILVINAPDGNTISATEHSVAMLLAMARNIPQAHQSLRNKEWNRKAFRGVELYGKTLGVIGAGRIGLGVAKRAQSFGMKILAFDPYLTEDKAKSLDIQIATVDEIAEKSDFVTVHTPLTPKTRGIVGSSFFNKAKQNLQIINVARGGIIDETALIEALDNNLIDRAAIDVFEHEPPTDSPLIQHDKIIVTPHLGASTVEAQEKVAVSVSEEIIEILTKGNVEHAVNAPKMDLSKVDKTTQSFIGLSTTIGEFAIQLLDGAPSEIKVKYAGDLAQNDTSLITRTIITNILKEDLGNEVNIINALAILNQQGVTYNIEKQKKHSGFSSYIELELVNDQDKIKIGATVFAGFGPRIVRINDYSLDFKPNQYQLVTCHKDKPGIVGQTGNLLGSHGINIASMTLGRNDAGGDALMILSIDQQASEEVIKILNETSGFNKIISTKLTI

SEQ ID NO: 580 - protein, 355 aa, Staphylococcus epidermidis
LKRNFINNLIILLIAIMLSLLLKMLHVILPFMFGPILAALLCVKVLKLKIRWPFWLSQIGLILLGVQIGSTFTQQVIKDISKNWLTIVFVTILLILLALIIAFFFKKIAQVNLETAILSVIPGALSQMLVMAEENKKANILVVSLTQTSRVIFVVILVPLISYFFQDNHHEMNHTTMEVPTLSQTLNIWQIIILFSMVGIIYIGMSKINFPTKQLLAPIIVLIIWNMTTHLTFSLDHWLLATAQLIYMIRIGLQIANLMSDLKGRIAIAIAFQNIMLIVTTFIMIIGIHLITNESINELFLGAAPGGMSQIVLVAMATGADVAMISSYHIFRIFFILFVIAPLIGYFINVKLNNK

SEQ ID NO: 581 - protein, 763 aa, Staphylococcus epidermidis
VKKTSRIIAFILLIALLFTGMGMTYKNVVKNVNLGLDLQGGFEVLFQVDPLNKGDKIDKKALQATSQTLENRVNVLGVSEPKIQIEDPNRIRVQLAGIKDQAQARKLLSTQANLTIRDAEDHVLMSGSDIKQGSAKQEFKQETNQPTVTFKVKSKDKFKKVTEKISKKRDNVMVVWLDFEKGDSYKKEAKKQQEGKKPKFISAASVDQPINSSSVEISGGFNGKKGVEEAKQIAELLNAGSLPVDLKEIYSNSVGAQFGQDALDKTMFASIVGIALIYLFMLGFYRLPGLVAIIALTTYIYLTLVAFNFISGVLTLPGLAALVLGVGMAVDANIIMYERIKDELRIGRTLKQAYSKANKSSFLTIFDSNLTTVIAAAVLFFFGESSVKGFATMLLLGILMIFVTAVFLSRGLLSLLVSSNFFKKQYWLFGVKKKDRHDINEGKDVHDLKTSYERLNFVKLAKPLISLSILIVIIGLIIISIFKLNLGIDFSSGTRADIQSKNAITQAQVEKTVKSVGLEPDQIQINGSGNKNATVQFKKDLSREEDNKLSAKVKSEFGDNPQINTVSPLIGQELAKNAVTALILASIGIIIYVSLRFEWRMGLSSVLALLHDVFIIIAIFSLFRLEVDLTFIAAVLTIVGYSINDTIVTFDRVRENLHKVKVITHTDQIDDIVNRSIRQTMTRSINTVLTVVVVVVAILILGAPTIFNFSLALLIGLLSGVFSSIFIAVPLWGMLKKRQFKKTKNNKLVVHKEKKSNDEKILV

SEQ ID NO: 582 - protein, 414 aa, Staphylococcus epidermidis
MGENTKQDFNQKGQNFKFTKKHRRLLYGSVFLMATSAIGPAFLTQTAVFTAQFYASFAFAILISIIIDIGAQINIWRILVVTGLRGQEISNKVLPGLGTIISILIAFGGLAFNIGNIAGAGLGLNAMFGLDVKWGAAITAIFAILIFVSRSGQKIMDVISMILGIVMILVVAYVMVVSNPPYGDALVHTFAPEHPFKLILPIITLVGGTVGGYITFAGAHRILDSGIKGKSYLPFVNRSAVAGILTTGVMRTLLFLAVLGVVVTGVTLSSENPPASVFQHALGPIGKNIFGVVIFAAAMSSVIGSAYTSATFLKTLHKSLLNKNNLIVITFIVISTFVFLFIGKPVSLLIIAGAINGWILPITLGAILIASRKKSIVGNYQHPTWMLVFGIIAVIVTIMTGIFSLQDLASLWKG

SEQ ID NO: 583 - protein, 460 aa, Staphylococcus epidermidis
VSNNNFKDDFEKNRQSINPDEHQTELKEDDKTNENKKEADSQNSLSNNSNQQFPPRNAQRRKRRRETATNQSKQQDDKHQKNSDAKTTEGSLDDRYDEAQLQQQHDKSQQQNKTEKQSQDNRMKDGKDAAIVNGTSESPEHKSKSTQNRPGPKAQQQKRKSESTQSKPSTNKDKKAATGAGIAGAAGVAGAAETSKRHHNKKDKQDSKHSNHENDEKSVKNDDQKQSKKGKKAAVGAGAAAGVGAAGVAHHNNQNKHHNEEKNSNQNNQYNDQSEGKKKGGFMKILLPLIAAILILGAIAIFGGMALNNHNDSKSDDQKIANQSKKDSDKKDGAQSEDNKDKKSDSNKDKKSDSDKNADDDSDNSSSNPNATSTNNNDNVANNNSNYTNQNQQDNANQNSNNQQATQGQQSHTVYGQENLYRIAIQYYGEGTQANVDKIKRANGLSSNNIHNGQTLVIPQ

SEQ ID NO: 584 - protein, 518 aa, Staphylococcus epidermidis
MAKGDQYQAHTEKYHDKKSKKSYKPVWIIISFIILITILLLPTPAGLPVMAKAALAILAFAVVMWVTEAVTYPVSATLILGLMILLLGLSPVQDLSEKLGNPKSGDIILKGSDILGTNNALSHAFSGFSTSAVALVAAALFLAVAMQETNLHKRLALLVLSIVGNKTRNIVIGAILVSIVLAFFVPSATARAGAVVPILLGMIAAFNVSKDSRLASLLIITAVQAVSIWNIGIKTAAAQNIVAINFINQNLGHDVSWGEWFLYAAPWSIIMSIALYFIMIKFMPPEHDAIEGGKELIKKELNKLGPVSHREWRLIVISVLLLFFWSTEKVLHPIDSASITLVALGIILMPKIGVITWKGVEKKIPWGTIIVFGVGISLGNVLLKTGAAQWLSDQTFGLMGLKHLPIIATIALITLFNILIHLGFASATSLASALIPVFISLTSTLNLGDHAIGFVLIQQFVISFGFLLPVSAPQNMLAYGTGTFTVKDFLKTGIPLTIVGYILVIVFSLTYWKWLGLV

SEQ ID NO: 585 - protein, 278 aa, Staphylococcus epidermidis
MLDFINHLLSYQFLNRALITSILVGIVCGTMGSIIVLRGLSLMGDAMSHAVLPGVALSFLFNIPMFIGALVTGMLASLFIGFITSNSKTKPDAAIGISFTAFLASGVIIISLINSTTDLYHILFGNLLAITHQSFWTTIVITVLVILLIIIFYRPLMISTFDATFSRMSGLNTTLIHYFVMLLLALVTVASIQTVGIILVVALLITPASTAFLISKQLYAMMVIASIISVISSIIGLYFSYIYNIPSGATIVICTFMIYIVTLSITRIKNKQKRSALT

SEQ ID NO: 586 - protein, 893 aa, Staphylococcus epidermidis
LAKLLYKLGKFIAKNKWLSVIGWLVILGVIITPLMINSPKFDSDITMNGLKSLDTNDKISKEFHQDSEKASMKIVFHSNKNDGLNNKDTKKDIEDALDNIRQNDDYIQNISNPYDSGQVNDEGDTAIANVSYVVPQTGLKDSSKHIIDKELKDVTDNHNVQIEKTQGGAMNSEPGGTSEIVGIIVAFVILLITFGSLIAAGMPIISAIIGLGSSVGIIALLTYIFDIPNFTLTLAVMIGLAVGIDYSLFILFRFKELKKKGVDTVEAIATAVGTAGSAVIFAGLTVMIAVCGLSLVGIDFLAVMGFASAISVLFAVLAALTLLPALISIFHKSIKIKDKPTKSKDPKDHSWAKFIVGKPVIAVIVSLIILILAAIPVSGMRLGIPDDSLKPTDSSEYKAYKLISDNFGEGYNGQIVMLVNTKDGGSKSTIERDLNNMRSDLEDIDNVDTVSKAQLTDNNNYALFTIIPEKGPNSQSTENLVYDLRDYHSQAQEKYDYGTEISGQSVINIDMSEKLNNAIPVFAGVIVVLAFFLLMIVFRSILVPLKAVLGFILSLMATLGFTTLVIQHGFMGSLFGIENTGPLLAFLPVITIGLLFGLAIDYELFLMTRVHEEYSKTGDNDHSIRVGIKESGPVIVAAALIMFSVFIAFVFQDDSAIKSMGIALGFGVLFDAFVVRMTLIPALTKLFGKASWYLPKWLGAVLPNVDVEGKALEEDNHHDTSSEKGHVNDKNSEYSRQDKDNYVYQNDKRNYNRNYNDEDYNRSVHLNNHHDQHHRQHQYDNQRDDIDYESLYTQDGDHTHHDERNYNDRHYQDNYDRNDDYRHNNHDHQNDNHDYHDSNFDKTTNLYKELTDSNIDQDVLFKALMLYARENNKGVYDRYNRSSQHRHDDELRD

SEQ ID NO: 587 - protein, 133 aa, Staphylococcus epidermidis
MNKKVEHIGNQYTSQENKKKQRQKMKMRVVRRRIALFGGILLAIILILLVLLVIQRHNNDQDAVERKEKETEFQKQQDEEIALKEKLNNLNDKDYIEKIARDDYYLSNKGEVIFRLPDDKKSSQSKTSNEKGN

SEQ ID NO: 588 - protein, 125 aa, Staphylococcus epidermidis
MKIRLTFIILAILSTIGLVLVLAKYPTGPHTINYNEPYTVLIAITTIVIMALPALILGIFNHLACRIISAILQISALMMWGFLVIISLIMGQIVIMLMASLTILALLVSSIVTLSVHPSTSDKIN

SEQ ID NO: 589 - protein, 372 aa, Staphylococcus epidermidis
MNKKLLWSIIGIVIIVVLIIAAFILKQVNGSGSKDSNAYDTYTVRKETPISLEGKASPESVKTYNNNQSVGNFLSVSVQDGQTVKQGERIINYDTNGNKRQQLLNKVNQAQSQVNDDYQKVNQSPNNHQLQVKLTQDQSALNEAQQSLSQYDRQLNDSMNASFDGKINIKNDSDVGEGQPILQLISSNPQINATITEFDINKIKEGDEVNVTVNSTGKKGKGKILKIDELPTSYDTSDDSTASSAQAGAQGDSEEGTEMTTSNPTINQPTGGKSGETSKYKVIIGDLDIPVRSGFSMDAKIPLKTKKLPNNVLTKDNNVFVVDKNNKVHKREIKIERNNGEIIVKKGLKSGDKVLKSPKGNLNDGEKVEVSS

SEQ ID NO: 590 - protein, 673 aa, Staphylococcus epidermidis
MAETTKIFESHLVKQALKDSVLKLYPVYMIKNPIMFVVEVGMLLALGLTIYPDLFHQESVSRLYVFSIFIILLLTLVFANFSEALAEGRGKAQANALRQTQTEMKARRIKQDGSYEMIDASDLKKGHIVRVATGEQIPNDGKVIKGLATVDESAITGESAPVIKESGGDFDNVIGGTSVASDWLEVEITSEPGHSFLDKMIGLVEGATRKKTPNEIALFTLLMTLTIIFLVVILTMYPLAKFLNFNLSIAMLIALAVCLIPTTIGGLLSAIGIAGMDRVTQFNILAKSGRSVETCGDVNVLILDKTGTITYGNRMADAFIPVKSSSFERLVKAAYESSIADDTPEGRSIVKLAYKQHIDLPQEVGEYIPFTAETRMSGVKFTTREVYKGAPNSMVKRVKEAGGHIPVDLDALVKGVSKKGGTPLVVLEDNEILGVIYLKDVIKDGLVERFRELREMGIETVMCTGDNELTAATIAKEAGVDRFVAECKPEDKINVIREEQAKGHIVAMTGDGTNDAPALAEANVGLAMNSGTMSAKEAANLIDLDSNPTKLMEVVLIGKQLLMTRGSLTTFSIANDIAKYFAILPAMFMAAMPAMNHLNIMHLHSPESAVLSALIFNALIIVLLIPIAMKGVKFKGASTQTILMKNMLVYGLGGMIVPFIGIKLIDLIIQLFV

SEQ ID NO: 591 - protein, 292 aa, Staphylococcus epidermidis
MIVLRRLFQDRGAIFAIAIITIYVVLGVLAPLITFYEPNHIDTANKFAGISWSHWLGTDHLGRDVLTRIIYAIRPSLLYVFVALIISVVIGAILGFISGYFPGYIDAIIMRICDVMLAFPSYVVTLALITLFGMGVENIIIAFILTRWAWFCRVIRTSVMQYIEADHVKFAKVIGMNDLTIIRKHILPLTFTDIAIIASSSMCSMILQMSGFSFLGLGVKAPTAEWGMMLNEARKVMFTHPGMMMTTGVAIVIIVMAFNFLSDALQMAIDPRMSAKEKRLALKKGVKARDTA

SEQ ID NO: 592 - protein, 396 aa, Staphylococcus epidermidis
MKGAMSWPFLRLYILTLMFFSANAILNVFIPLRGHDLGATNTVIGIVMGAYMLTAMLCRPWAGQIIARIGPIKVLRIILLINAMALVLYGFTGLEGYLIARIMQGVCTAFFSMSLQLGIIDALPEKYRSEGVSLYSLFSTIPNLLGPLIAVGIWHVENMSIFAIVMIFIAVTTTLFGYRTTFANTQKEVSPKDEVLPFNAMTVYVQFFKNKALFCSGMIMILSSIVFGAMSTFIPLYTVREGFANAGIFLTIQAITVVIARFYLRKYVPSDGLWHHRFMMIVLTLLMVASVIVAFGPHIVSIFVYISAIFIGITQALVYPTLTTYLSFVLPKIGRNMLLGLFIACADLGISLGGVLMGPISDTVGFKWMYILCALLVTIAMTLSKIRQRQSVSKAS

SEQ ID NO: 593 - protein, 472 aa, Staphylococcus epidermidis
VGSTVKYRKFILPIVVGLIIWALTPIKPDALNDQAWFMFAIFVSTIIACITQPMTIGAVSIIGFTIMILVGIVDTKTAVQGFGNSSIWLIAMAFFISRGFVKTGLGRRIALQFVKLFGKKTLGLAYSLVGVDLILAPATPSNTARAGGIMFPIIKSLSESFGSSPRDGSERKMGAFLIFTEFQGNLITSAMFLTAMAGNPIAQSLAEKTAHVQITWMNWFVAAIIPGLISLIVVPFIIYKLYPPTVKETPNAKKWATEQLEEMGHMSIAEKLMVGIFIIALALWVLGSFINVDATLTAFIALALLLLTGVLAWSDILNETGAWNTLVWFSVLVLMAEQLNKLGFIPWLSKLIAQGLNGFSWPIVLVLLILFYFYSHYLFASATAHVSAMYAALLGVAVASGAPPLFSALMLGFFGNLLASTTHYSSGPAPILYAAGYVTQKRWWTMNIVLGIVYFIIWIGVGSLWMKLIGMM

SEQ ID NO: 594 - protein, 391 aa, Staphylococcus epidermidis
MKDNKMLFIIFMIGTFTVGMAEYVVTGLLTQIADDMKVSISSAGLLISVYAISVALIGPLMRIITLKVHAHRLLPILVAIFIISNLVGMLAPNFNVLLLSRLMSAAMHAPFFGVCMSVAATVAPPAKKTQAIALVQAGLTIAVMLGVPFGSFLGGFANWRVVFGFMIVLAIITMLGMIKFVPNVSLSAEANISKELTVFKNPHILIVIAIIVFGYSGVFTTYTFMEPMIRDFSPFKIVGLTVCLFMFGLGGVIGNLITGNVPEDKLTKNLYLTFLLLFVTIILFVTVIQNSILALIICFLFGFGTFGTTPLLNSKIILSGKEAPLLASTLAASIFNVANFLGAIIGSILLSIGLPYIQITLISGGIIVLGMLLNLVNQLYEKKHITFNEYS

SEQ ID NO: 595 - protein, 336 aa, Staphylococcus epidermidis
MAVKVAINGFGRIGRLAFRRIQEVEGLEVVAVNDLTDDDMLAHLLKYDTMQGRFTGEVEVVDGGFRVNGKEVKSFSEPDASKLPWKDLNIDVVLECTGFYTDKDKAQAHIEAGAKKVLISAPATGDLKTIVFNTNHQELDGSETVVSGASCTTNSLAPVAKVLNDDFGLVEGLMTTIHAYTGDQNTQDAPHRKGDKRRARAAAENIIPNSTGAAKAIGKVIPEIDGKLDGGAQRVPVATGSLTELTVVLEKQDVTVEQVNEAMKNASNESFGYTEDEIVSSDVVGMTYGSLFDATQTRVMSVGDRQLVKVAAWYDNEMSYTAQLVRTLAYLAELSK

SEQ ID NO: 596 - protein, 178 aa, Staphylococcus epidermidis
VKRLKNFILGLLIVAIVGFLLFMYIDDSRIQSYQDYFLQFNWFQPLLIGLAGLLILIGLILVLSIFKPTHRKPGLYKNFDDGHIYVSRKAVEKTIYDTIAKYDQVRQPNVVSKLYNKKNKSFIDIKADFFVPNHVQVKSLTESIRADIKSNVEHFTEIPVRKLEVNVRDQKTSGPRVL

SEQ ID NO: 597 - protein, 430 aa, Staphylococcus epidermidis
MSFLRKHTEIIFSYIIGIVSLFTGLIIFINLPLIKQFKGDKKVDTHVHNVWEFLNAFFAEIIKVMSKFIGGFPITSAIVIIVFGILVMLLGHTLFRTIKYDYDISIFFLVIGIMYFIITLLLMTQVYGFFAIVFIIPFTVHIGYIVYKDELNQDNRKNHYMWIIVTYGMSYLITQISLYGRIDANEIESIDILSVNTFFIIMWLLGQMAIWNFLFLRRSLPLTKEELGEEEPELSRTNKGNVSNQTKVHLKQLQNKTTEYARKTRRSVDLDKIRAKRDKFKQKINSIVDIQEDDIPNWMKKPKWVKPMYVQLFCGVIILFFAFLEFNNRNALFLTGEWELSQTQYVVEWVTLLLLLFIIIIYIATTLTYYLRDKYYYLQLFMGSILFFKFLTEFINIMVHGLLLSIFITPILLLMLIAMIVAYSLQLREK

SEQ ID NO: 598 - protein, 221 aa, Staphylococcus epidermidis
MQQETTSWYKQEWFIVLSLLFIFPLGLFLMWKFSKWPSIARTIITVAISVIVLASITYYGNLQMIVPATSNSNNETKETTENNVNDKDERNHKTAVEETKTNYDSTKENTKEPGKENESATRLENSALEKAKSYYDDFHMSKLGIYDILTSEYGEKFDKEDAQYAIDHLEADYEKNALEKAKSYAKDMHMSNDSIYDLLVSNYGEKFTESEAKYAIEHLDN

SEQ ID NO: 599 - protein, 36 aa, Artificial Sequence
  Description of Artificial Sequence:  Synthetic Peptide
RLAGLLRKGGEKIGEKLKKIGQKIKNFFQKLVPQPE

SEQ ID NO: 600 - DNA, 107 bp, Artificial Sequence
  Description of Artificial Sequence:  Synthetic Primer
cgaataatacgactcactatagggagaccacaacggtttcccactagtaataattttgtttaactttaagaaggagatatatccatgcagaccttggccggcctccc

SEQ ID NO: 601 - DNA, 48 bp, Artificial Sequence
  Description of Artificial Sequence:  Synthetic Primer
ggcccacccgtgaaggtgagccggcgtaagatgcttttctgtgactgg

SEQ ID NO: 602 - protein, 13 aa, Artificial Sequence
  Description of Artificial Sequence:  Synthetic Peptide
PKYVKQNTLKLAT

SEQ ID NO: 603 - protein, 13 aa, Artificial Sequence
  Description of Artificial Sequence:  Synthetic Peptide
YPKFVKQNTLKAA

SEQ ID NO: 604 - protein, 55 aa, Artificial
  Synthetic peptide
MNKNSKKKLDFLPNKLNKYSIRRFTVGTASILVGATLIFGVANDQAEAAENNTTQ

SEQ ID NO: 605 - protein, 57 aa, Artificial
  Synthetic peptide
MNNKKTATNRKGMIPNRLNKFSIRKYSVGTASILVGTTLIFGLSGHEAKAAEHTNGE

SEQ ID NO: 606 - protein, 58 aa, Artificial
  Synthetic peptide
MLNRENKTAITRKGMVSNRLNKFSIRKYTVGTASILVGTTLIFGLGNQEAKAAESTNK

SEQ ID NO: 607 - protein, 54 aa, Artificial
  Synthetic peptide
MINRDNKKAITKKGMISNRLNKFSIRKYTVGTASILVGTTLIFGLGNQEAKAAE

SEQ ID NO: 608 - protein, 46 aa, Artificial
  Synthetic peptide
MNMKKKEKHAIRKKSIGVASVLVGTLIGFGLLSSKEADASENSVTQ

SEQ ID NO: 609 - protein, 51 aa, Artificial
  Synthetic peptide
MKKRIDYLSNKQNKYSIRRFTVGTTSVIVGATILFGIGNHQAQASEQSNDT

SEQ ID NO: 610 - protein, 44 aa, Artificial
  Synthetic peptide
MKNNLRYGIRKHKLGAASVFLGTMIVVGMGQDKEAAASEQKTTT

SEQ ID NO: 611 - protein, 44 aa, Artificial
  Synthetic peptide
MKSNLRYGIRKHKLGAASVFLGTMIVVGMGQEKEAAASEQNNTT

SEQ ID NO: 612 - protein, 43 aa, Artificial
  Synthetic peptide
MKKKNIYSIRKLGVGIASVTLGTLLISGGVTPAANAAQHDEAQ

SEQ ID NO: 613 - protein, 45 aa, Artificial
  Synthetic peptide
MNLFRQQKFSIRKFNVGIFSALIATVTFISTNPTTASAAEQNQPA

SEQ ID NO: 614 - protein, 47 aa, Artificial
  Synthetic peptide
MNKHHPKLRSFYSIRKSTLGVASVIVSTLFLITSQHQAQAAENTNTS

SEQ ID NO: 615 - protein, 57 aa, Artificial
  Synthetic peptide
MRDKKGPVNKRVDFLSNKLNKYSIRKFTVGTASILIGSLMYLGTQQEAEAAENNIEN

SEQ ID NO: 616 - protein, 44 aa, Artificial
  Synthetic peptide
MNLLKKNKYSIRKYKVGIFSTLIGTVLLLSNPNGAQALTTDNNV

SEQ ID NO: 617 - protein, 41 aa, Artificial
  Synthetic peptide
MKSQNKYSIRKFSVGASSILIATLLFLSGGQAQAAEKQVNM

SEQ ID NO: 618 - protein, 49 aa, Artificial
  Synthetic peptide
TIAVNYRDKIQKFSIRKYTVGTFSTVIATLVFLGFNTSQAHAAETNQPA

SEQ ID NO: 619 - protein, 35 aa, Artificial
  Synthetic peptide
NKNVLKFMVFIMLLNIITPLFNKNEAFAARDISST

SEQ ID NO: 620 - protein, 34 aa, Artificial
  Synthetic peptide
KFKSLITTTLALGVIASTGANFNTNEASAAAKPL

SEQ ID NO: 621 - protein, 47 aa, Artificial
  Synthetic peptide
IIYWCMTVNGGNEMKALLLKTSVWLVLLFSVMGLWQVSNAAEQHTPM

SEQ ID NO: 622 - protein, 53 aa, Artificial
  Synthetic peptide
SKRQKAFHDSLANEKTRVRLYKSGKNWVKSGIKEIEMFKIMGLPFISHSLVSQ

SEQ ID NO: 623 - protein, 42 aa, Artificial
  Synthetic peptide
KKIKIVPLILIVVVVGFGIYFYASKDKEINNTIDAIEDKNFK

SEQ ID NO: 624 - protein, 42 aa, Artificial
  Synthetic peptide
AKTLPDTGMSHNDDLPYAELALGAGMAFLIRRFTKKDQQTEE

SEQ ID NO: 625 - protein, 43 aa, Artificial
  Synthetic peptide
NKELPDTGNDAQNNGTLFGSLFAALGGLFLVGRRRKNKNNEEK

SEQ ID NO: 626 - protein, 41 aa, Artificial
  Synthetic peptide
AKALPETGNENSGSNNATLFGGLFAALGSLLLFGRRKKQNK

SEQ ID NO: 627 - protein, 36 aa, Artificial
  Synthetic peptide
LKELPKTGMKIITSWITWVFIGILGLYLILRKRFNS

SEQ ID NO: 628 - protein, 41 aa, Artificial
  Synthetic peptide
AKALPETGSENNGSNNATLFGGLFAALGSLLLFGRRKKQNK

SEQ ID NO: 629 - protein, 40 aa, Artificial
  Synthetic peptide
KSELPETGGEESTNKGMLFGGLFSILGLALLRRNKKNHKA

SEQ ID NO: 630 - protein, 41 aa, Artificial
  Synthetic peptide
AKALPETGSENNNSNNGTLFGGLFAALGSLLSFGRRKKQNK

SEQ ID NO: 631 - protein, 40 aa, Artificial
  Synthetic peptide
KSELPETGGEESTNNGMLFGGLFSILGLALLRRNKKNHKA

SEQ ID NO: 632 - protein, 41 aa, Artificial
  Synthetic peptide
KEPLPDTGSEDEANTSLIWGLLASIGSLLLFRRKKENKDKK

SEQ ID NO: 633 - protein, 43 aa, Artificial
  Synthetic peptide
TDALPETGDKSENTNATLFGAMMALLGSLLLFRKRKQDHKEKA

SEQ ID NO: 634 - protein, 38 aa, Artificial
  Synthetic peptide
AQALPETGEENPFIGTTVFGGLSLALGAALLAGRRREL

SEQ ID NO: 635 - protein, 37 aa, Artificial
  Synthetic peptide
EKQLPKTGTNKSSSPEAMFVLLAGIGLIATVRRRKAS

SEQ ID NO: 636 - protein, 40 aa, Artificial
  Synthetic peptide
EKRLPDTGDSIKQNGLLGGVMTLLVGLGLMKRKKKKDEND

SEQ ID NO: 637 - protein, 39 aa, Artificial
  Synthetic peptide
EKELPNTGSEGMDLPLKEFALITGAALLARRRTKNEKES

SEQ ID NO: 638 - protein, 36 aa, Artificial
  Synthetic peptide
RAELPKTGLESTQKGLIFSSIIGIAGLMLLARRRKN

SEQ ID NO: 639 - protein, 38 aa, Artificial
  Synthetic peptide
SKMLPKTGETTSSQSWWGLYALLGMLALFIPKFRKESK

SEQ ID NO: 640 - protein, 6 aa, Artificial
  Synthetic peptide
  misc_feature (3)..(3): Xaa can be any naturally occurring amino acid
LPXTGV

SEQ ID NO: 641 - protein, 5 aa, Artificial
  Synthetic peptide
  misc_feature (3)..(3): Xaa can be any naturally occurring amino acid
LPXTG

The invention claimed is:

1. An isolated antigen comprising the sequence of SEQ ID NO. 142 or an antigenic fragment of SEQ ID NO. 142, wherein the antigenic fragment of SEQ ID NO: 142 comprises the sequence of one or more of amino acids 9-33, 56-62, 75-84, 99-105, 122-127, 163-180, 186-192, 206-228, 233-240, 254-262, 275-283, 289-296, 322-330, 348-355, 416-424, 426-438, 441-452, 484-491, 522-528, 526-544, 527-544, 541-549, 563-569, 578-584, 624-641, 1-42, 6-30, 18-42, 24-53, 209-244, 209-233, 218-244, 395-428, 395-418, 416-428, or 623-647 of SEQ ID NO. 142.

2. The isolated antigen of claim 1 consisting of the sequence of SEQ ID NO. 142.

3. The isolated antigen of claim 1, wherein said antigen consists of an antigenic fragment of SEQ ID NO. 142.

4. The isolated antigen of claim 1, wherein the antigenic fragment of SEQ ID NO. 142 comprises at least 6 amino acids of SEQ ID NO. 142.

5. The isolated antigen of claim 1, wherein the antigenic fragment of SEQ ID NO. 142 comprises at least 8 amino acids of SEQ ID NO. 142.

6. The isolated antigen of claim 1, wherein the antigenic fragment of SEQ ID NO. 142 comprises at least 12 amino acids of SEQ ID NO. 142.

7. The isolated antigen of claim 1, wherein the antigenic fragment of SEQ ID NO. 142 is selected from the group consisting of amino acids 9-33, 56-62, 75-84, 99-105, 122-127, 163-180, 186-192, 206-228, 233-240, 254-262, 275-283, 289-296, 322-330, 348-355, 416-424, 426-438, 441-452, 484-491, 522-528, 526-544, 527-544, 541-549, 563-569, 578-584, and 624-641 of SEQ ID NO. 142.

8. The isolated antigen of claim 1, wherein the antigenic fragment of SEQ ID NO. 142 is selected from the group consisting of amino acids 527-544 of SEQ ID NO. 142 and amino acids 484-491 of SEQ ID NO. 142.

9. The isolated antigen of claim 1, wherein the antigen comprises amino acids 527-544 of SEQ ID NO. 142 or amino acids 484-491 of SEQ ID NO. 142.

10. The isolated antigen of claim 9, wherein the antigen comprises SEQ ID NO. 142.

11. The isolated antigen of claim 1, wherein the antigenic fragment of SEQ ID NO. 142 is selected from the group consisting of amino acids 1-42, 6-30, 18-42, 24-53, 209-244, 209-233, 218-244, 395-428, 395-418, 416-428, 623-647 of SEQ ID NO. 142.

12. A method of producing an antibody comprising:
initiating an immune response in a non-human animal by administering an antigen of claim 1 to said animal;
removing the spleen or spleen cells from said animal;
producing hybridoma cells of said spleen or spleen cells;
selecting and cloning hybridoma cells specific for the antigen; and
producing the antibody by cultivation of said cloned hybridoma cells.

13. A method of producing an antibody preparation comprising:
initiating an immune response in a non-human animal by administering an antigen of claim 1 to said animal;
removing an antibody containing body fluid from said animal; and
producing the antibody preparation by subjecting said antibody containing body fluid to purification steps.

* * * * *

UNITED STATES PATENT AND TRADEMARK OFFICE
CERTIFICATE OF CORRECTION

| | | |
|---|---|---|
| PATENT NO. | : 7,771,728 B2 | Page 1 of 1 |
| APPLICATION NO. | : 11/614716 | |
| DATED | : August 10, 2010 | |
| INVENTOR(S) | : Andreas Meinke et al. | |

It is certified that error appears in the above-identified patent and that said Letters Patent is hereby corrected as shown below:

In column 1, lines 9-10, delete "Jan. 21, 2001" and insert --Jan. 26, 2001-- therefor.

Signed and Sealed this

Twenty-third Day of November, 2010

David J. Kappos
*Director of the United States Patent and Trademark Office*

UNITED STATES PATENT AND TRADEMARK OFFICE
CERTIFICATE OF CORRECTION

PATENT NO. : 7,771,728 B2
APPLICATION NO. : 11/614716
DATED : August 10, 2010
INVENTOR(S) : Andreas Meinke et al.

Page 1 of 1

It is certified that error appears in the above-identified patent and that said Letters Patent is hereby corrected as shown below:

Title Page, Item (30) Foreign Application Priority Data and
In column 1, lines 9-10, delete "Jan. 21, 2001" and insert --Jan. 26, 2001-- therefor.

This certificate supersedes the Certificate of Correction issued November 23, 2010.

Signed and Sealed this
First Day of February, 2011

David J. Kappos
*Director of the United States Patent and Trademark Office*

UNITED STATES PATENT AND TRADEMARK OFFICE
CERTIFICATE OF CORRECTION

PATENT NO. : 7,771,728 B2  
APPLICATION NO. : 11/614716  
DATED : August 10, 2010  
INVENTOR(S) : Andreas Meinke et al.

Page 1 of 1

It is certified that error appears in the above-identified patent and that said Letters Patent is hereby corrected as shown below:

In column 19, line 58 to column 20, line 2, delete paragraph:
"FIG. 11 shows a 2D gel where *S. aureus* surface proteins are stained by Coomassie Blue (left). 1 mg protein from *S. aureus*/agr grown to early log phase was resolved by IEF (pI 6-11) and SDS-PAGE(9-16%). Spots selected for sequencing after serological proteome analysis are marked. Corresponding 2D-immunoblot (right). 800 µg protein from the same preparation was resolved in parallel by 2DE, and subsequently transferred to PVDF membrane. After blocking, the membrane was incubated with the P-pool (1:10,000). Binding of serum IgG was visualized by an anti-human IgG/HRPO conjugate and ECL development."

Signed and Sealed this  
Fifteenth Day of February, 2011

David J. Kappos  
*Director of the United States Patent and Trademark Office*